(12) United States Patent
Damude et al.

(10) Patent No.: US 8,828,690 B2
(45) Date of Patent: Sep. 9, 2014

(54) MULTIZYMES COMPRISING DELTA-9 ELONGASE AND DELTA-8 DESATURASE AND THEIR USE IN MAKING POLYUNSATURATED FATTY ACIDS

(75) Inventors: Howard G. Damude, Hockessin, DE (US); Anthony J. Kinney, Wilmington, DE (US); Kevin G. Ripp, Wilmington, DE (US); Quinn Qun Zhu, West Chester, PA (US)

(73) Assignee: E I du Pont de Nemours and Company, Wilmington, DE (US)

( * ) Notice: Subject to any disclaimer, the term of this patent is extended or adjusted under 35 U.S.C. 154(b) by 1008 days.

(21) Appl. No.: 12/061,738

(22) Filed: Apr. 3, 2008

(65) Prior Publication Data
US 2008/0254191 A1 Oct. 16, 2008

Related U.S. Application Data

(60) Provisional application No. 60/909,790, filed on Apr. 3, 2007, provisional application No. 61/027,898, filed on Feb. 12, 2008.

(51) Int. Cl.
*C12N 15/05* (2006.01)
*C12N 15/82* (2006.01)
*A01H 5/10* (2006.01)
*C07H 21/04* (2006.01)
*C12P 7/64* (2006.01)
*C12P 21/04* (2006.01)
*C12N 9/02* (2006.01)

(52) U.S. Cl.
USPC .......... 435/134; 435/69.7; 435/189; 435/468; 800/281; 800/295; 536/23.2; 536/23.4; 536/23.74; 536/24.2

(58) Field of Classification Search
None
See application file for complete search history.

(56) References Cited

U.S. PATENT DOCUMENTS

| | | | |
|---|---|---|---|
| 5,547,868 A * | 8/1996 | Miller et al. .................. 435/189 |
| 5,952,544 A | 9/1999 | Browse et al. |
| 5,968,809 A | 10/1999 | Knutzon et al. |
| 6,075,183 A | 6/2000 | Knutzon et al. |
| 6,403,349 B1 | 6/2002 | Mukerji et al. |
| 6,677,145 B2 | 1/2004 | Mukerji et al. |
| 6,825,017 B1 | 11/2004 | Browse et al. |
| 7,045,683 B2 | 5/2006 | Mukerji et al. |
| 7,087,432 B2 | 8/2006 | Qiu et al. |
| 7,125,672 B2 | 10/2006 | Picataggio et al. |
| 7,214,491 B2 | 5/2007 | Yadav et al. |
| 7,238,482 B2 | 7/2007 | Picataggio et al. |
| 7,256,033 B2 * | 8/2007 | Damude et al. ............ 435/252.3 |
| 7,615,679 B2 | 11/2009 | Lerchl et al. |
| 7,645,604 B2 * | 1/2010 | Damude et al. ............... 435/193 |
| 7,714,185 B2 * | 5/2010 | Napier et al. .................. 800/281 |
| 2004/0053379 A1 * | 3/2004 | Lerchl et al. .................. 435/134 |

FOREIGN PATENT DOCUMENTS

| | | |
|---|---|---|
| WO | WO 93/11245 | 6/1993 |
| WO | WO 00/12720 | 3/2000 |
| WO | WO 00/34439 | 6/2000 |
| WO | WO 02/08401 | 1/2002 |
| WO | WO 02/077213 | 10/2002 |
| WO | WO 02/081668 | 10/2002 |
| WO | WO 02/090493 | 11/2002 |
| WO | WO 2004/057001 | * 7/2004 |
| WO | WO2004/057001 | * 7/2004 |
| WO | WO 2004/071467 | 8/2004 |
| WO | WO 2004/101753 | 11/2004 |
| WO | WO 2005/047479 | 5/2005 |
| WO | WO 2005/047485 | 5/2005 |
| WO | WO 2005/103253 | 11/2005 |
| WO | WO 2006/012325 | 2/2006 |
| WO | WO 2006/012326 | 2/2006 |
| WO | WO 2007/046817 | 4/2007 |
| WO | WO 2007/061742 | 5/2007 |

OTHER PUBLICATIONS

U.S. Appl. No. 10/552,127, Oct. 5, 2005, BASF Plant Science GmBH.
U.S. Appl. No. 11/264,737, Nov. 1, 2005, E.I. du Pont de Nemours and Company.
U.S. Appl. No. 11/264,784, Nov. 1, 2005, E.I. du Pont de Nemours and Company.
U.S. Appl. No. 11/265,761, Nov. 2, 2005, E.I. du Pont de Nemours and Company.
U.S. Appl. No. 11/601,563, Nov. 16, 2006, E.I. du Pont de Nemours and Company.
U.S. Appl. No. 11/601,564, Nov. 16, 2006, E.I. du Pont de Nemours and Company.
U.S. Appl. No. 11/635,258, Dec. 7, 2006, E.I. du Pont de Nemours and Company.
U.S. Appl. No. 11/737,772, Apr. 20, 2007, E.I. du Pont de Nemours and Company.
U.S. Appl. No. 11/748,629, May 5, 2007, E.I. du Pont de Nemours and Company.
U.S. Appl. No. 11/748,637, May 15, 2007, E.I. du Pont de Nemours and Company.
U.S. Appl. No. 11/779,915, Jul. 19, 2007, E.I. du Pont de Nemours and Company.

(Continued)

*Primary Examiner* — Eileen B O Hara
*Assistant Examiner* — Matthew Keogh

(57) ABSTRACT

Isolated nucleic acid fragments and recombinant constructs comprising such fragments encoding multizymes (i.e., single polypeptides having at least two independent and separable enzymatic activities) along with a method of making long-chain polyunsaturated fatty acids (PUFAs) using these multizymes in plants and oleaginous yeast are disclosed.

20 Claims, 81 Drawing Sheets

(56) References Cited

OTHER PUBLICATIONS

U.S. Appl. No. 11/876,115, Oct. 22, 2007, E.I. du Pont de Nemours and Company.
U.S. Appl. No. 60/911,925, Apr. 16, 2007, E.I. du Pont de Nemours and Company.
U.S. Appl. No. 60/915,733, May 3, 2007, E.I. du Pont de Nemours and Company.
U.S. Appl. No. 60/910,831, Apr. 10, 2007, E.I. du Pont de Nemours and Company.
National Center for Biotechnology Information General Identifier No. 25956288, Accession No. AAN75707, Nov. 30, 2002, J. M. Thurmond et al., Identification of delta 4-desaturase, a key enzyme in docosahexaenoic acid production, from Thraustochytrium aureum by heterologous expression in yeast.
National Center for Biotechnology Information General Identifier No. 33466346, Accession No. AAQ19605, Aug. 22, 2003, A. Meyer et al., Biosynthesis of docosahexaenoic acid in *Euglena gracilis*: Biochemical and molecular evidence for the involvememnt of a delta 4-fatty acyl group desaturase.
National Center for Biotechnology Information General Identifier No. 37683439, Accession No. AAQ98793, Nov. 7, 2003, T. Tonon et al., Identification of a very long chain polyunsaturated fatty acid delta4-desaturase from the microalga Pavlova lutheri.
National Center for Biotechnology Information General Identifier No. 54307108, Accession No. AAV33630, Dec. 7, 2004, S. L. Pereira Identification of two novel microalgal enzymes involved in the conversion of the omega3-fatty acid, eicosapentaenoic acid, into docosahexaenoic acid.
National Center for Biotechnology Information General Identifier No. 54307110, Accession No. AAV33631, Dec. 7, 2004, S. L. Pereira, Identification of two novel microalgal enzymes involved in the conversion of the omega3-fatty acid, eicosapentaenoic acid, into docosahexaenoic acid.
National Center for Biotechnology Information General Identifier No. 55852396, Accession No. AAV67798, Nov. 24, 2004, A. Meyer et al., Novel fatty acid elongases and their use for the reconstitution of docosahexaenoic acid biosynthesis.
National Center for Biotechnology Information General Identifier No. 55852441, Accession No. AAV67800, Nov. 24, 2004, A. Meyer et la., Novel fatty acid elongases and their use for the reconstitution of docosahexaenoic acid biosynthesis.
National Center for Biotechnology Information General Identifier No. 60173017, Accession No. AAX14506, Jul. 16, 2005, T. Tonon et al., Fatty acid desaturases from the microalga *Thalassiosira pseudonana*.
National Center for Biotechnology Information General Identifier No. 17226122, Accession No. AF390174, Mar. 9, 2006, B. Qi et al., Identification of a cDNA encoding a novel C18-Delta(9) polyunsaturated fatty acid-specific elongating activity from the docosahexaenoic acid (DHA)-producing microalga, *Isochrysis galbana*.
National Center for Biotechnology Information General Identifier No. 25956287, Accession No. AF391543, Nov. 30, 2002, J. M. Thurmond et al., Identification of delta 4-desaturase, a key enzyme in docosahexaenoic acid production, from *Thraustochytrium aureum* by heterologous expression in yeast.
National Center for Biotechnology Information General Identifier No. 27902576, Accession No. AY204712, May 17, 2005, K. D. Bilyeu et al., Three microsomal omega-3-fatty acid desaturase genes contribute to soybean linolenic acid levels.
National Center for Biotechnology Information General Identifier No. 33466345, Accession No. AY278558, Aug. 22, 2003, A. Meyer et al., Biosyntheses of docosahexaenoic acid in *Euglena gracilis*: Biochemical and molecular evidence for the Involvement of a delta 4-fatty acyl group desaturase.
National Center for Biotechnology Information General Identifier No. 55852395, Accession No. AY591336, Nov. 24, 2004, A. Meyer et al., Novel fatty acid elongases and their use for the reconstruction of docosahexaenoic acid biosyntheses.
National Center for Biotechnology Information General Identifier No. 55852440, Accession No. AY591338, Nov. 24, 2004, A. Meyer et al., Novel fatty acid elongases and their use for the reconstitution of docosahexaenoic acid biosynthesis.
National Center for Biotechnology Information General Identifier No. 54307107, Accession No. AY630573, Dec. 7, 2004, S. L. Pereria, Identification of two novel microalgal enzmyes involved in the conversion of the omega3-fatty acid, eicosapentaenoic acid, into docosahexaenoic acid.
National Center for Biotechnology Information General Identifier No. 54307109, Accession No. AY630574, Dec. 7, 2004, S. L. Pereira, Identification of two novel microalgal enzymes involved in the conversion of the omega3-fatty acid, eicosapentaenoic acid, into docosahexaenoic acid.
National Center for Biotechnology Information General Identifier No. 60173016, Accession No. AY817156, Jul. 16, 2005, T. Tonon et al., Fatty acid desaturases from the microalga *Thalassiosira pseudonana*.
National Center for Biotechnology Information General Identifier No. 21900885, Accession No. CAD42496, Jul. 16, 2002, X. Qiu et al., Fad4, fad5, fad5-2, and fad6, novel fatty acid desaturase family members and uses thereof.
National Center for Biotechnology Information General Identifier No. 408793, Accession No. L22964, Jan. 31, 1995, N. S. Yadav et al., Cloning of higher plant omega-3 fatty acid desaturases.
Meyer et al., Biochemistry, Biosynthesis of Docosahexaenoic Acid in *Euglena gracilis*: Biochemical and Molecular evidence for the Involvement of a Delta4-Fatty Acyl Group Desaturase, vol. 42(32), pp. 9779-9788 (2003).
Meyer et al., Journal of Lipid Research, Novel fatty acid elongases and their use for the reconstitution of docosahexaenoic acid biosyntheses, vol. 45(10), pp. 1899-1909 (2004).
Pereira et al., Biochemical Journal, Identification of two novel microalgal enzymes Involved in the conversion of the Delta3-fatty acid, eicosapentaenoic acid, into docosahexaenoic acid, vol. 384(2), pp. 357-366 (2004).
Tonon et al., FEBS Journal, Fatty acid desaturases from the microalga *Thalassiosira pseudonana*, vol. 272(13), pp. 3401-3412 (2005).

\* cited by examiner

FIG. 2

```
                       Divergent sequence
                       ─────────────────→          Sequence identical start
                                                   ↓
EgDHAsyn2_CDS.seq  ATGGAAGAAGATCTTGACACAGCTCCAGATGGTTCAATTC  660
EgD4_cDNA.seq      GGGCGTAA----TTAACA-ATCGACAGCGGCCCGGAATT   654
EgD4_CDS.seq       ---------------------------------------    0

NotI site
                       ┌────────┐
EgDHAsyn2_CDS.seq  TGTTTCTGTTTTACACATTCCATTTATGTGTGGATTTGCG  700
EgD4_cDNA.seq      C│GCGGCCCGC│T---CACATTCCATTTATGTGTGGATTTGCG  691
EgD4_CDS.seq       └────────┘----------------------------     0

EgDHAsyn2_CDS.seq  GGTCAGAGATCTACCCACGGCCCTGACTGCTTTTGCAGTC  740
EgD4_cDNA.seq      GGTCAGAGATCTACCCACGGCCCTCTGACTGCTTTTGCAGTC 731
EgD4_CDS.seq       ---------------------------------------    0

↓ EgD4 CDS Start
EgDHAsyn2_CDS.seq  GTTCGTGATGGTCAATATGTTGGTGCTGTTTTTGGCAATTTC  780
EgD4_cDNA.seq      GTTCGTGATGGTCAATATGTTGGTGCTGTTTTTGGCAATTTC  771
EgD4_CDS.seq       ---------ATGTTGGTGCTGTTTTTGGCAATTTC         24

EgDHAsyn2_CDS.seq  TATGTCAAGCAATACTCCCAAAAGAACGGCAAGCCGGAGA  820
EgD4_cDNA.seq      TATGTCAAGCAATACTCCCAAAAGAACGGCAAGCCGGAGA  811
EgD4_CDS.seq       TATGTCAAGCAATACTCCCAAAAGAACGGCAAGCCGGAGA   64

EgDHAsyn2_CDS.seq  ACGGAGCCCACCCCCCCCCGGTGGGAAAAACGGAGCCCGAAACCCTTG  860
EgD4_cDNA.seq      ACGGAGCCCACCCCCCCCCGGTGGGAAAAACGGAGCCCGAAACCCTTG  851
EgD4_CDS.seq       ACGGAGCCCACCCCCCCCCGGTGGGAAAAACGGAGCCCGAAACCCTTG  104

EgDHAsyn2_CDS.seq  CGAGAACGGCCCACCCCCCCACCCCCGGAAAAGCGAGAATGACACCGCC  900
EgD4_cDNA.seq      CGAGAACGGCCCACCCCCCCACCCCCGGAAAAGCGAGAATGACACCGCC  891
EgD4_CDS.seq       CGAGAACGGCCCACCCCCCCACCCCCGGAAAAGCGAGAATGACACCGCC  144

EgDHAsyn2_CDS.seq  AACGTTCGGCCCCACCCCCCGTCCCAGCTGGACGCCCCGGCCA  940
EgD4_cDNA.seq      AACGTTCGGCCCCACCCCCCGTCCCAGCTGGACGCCCCGGCCA  931
EgD4_CDS.seq       AACGTTCGGCCCCACCCCCCGTCCCAGCTGGACGCCCCGGCCA  184
```

EgDHAsyn2_CDS is nt 621-940 of SEQ ID NO:21, EgD4_cDNA is nt 621-931 of SEQ ID NO:23, and EgD4_CDS is nt 1-184 of SEQ ID NO:24.

EgC20elo1 (SEQ ID NO:6), EgDHAsyn1 (SEQ ID NO:12) and EgDHAsyn2 (SEQ ID NO:22).

N-terminus of EgDHAsyn1 (SEQ ID NO:12) and EgDHAsyn2 (SEQ ID NO:22) with EgC20elo1 (SEQ ID NO:6), Pavlova sp. CCMP459 C20-PUFA Elo (SEQ ID NO:2), Ostreococcus tauri PUFA elongase 2 (SEQ ID NO:25) and Thalassiosira pseudonana PUFA elongase 2 (SEQ ID NO:26).
Pavlova, Ostreococcus and Thalassiosira proteins are labeled as PavC20elo, OtPUFAelo2 and TpPUFAelo2, respectively.

The Clustal W alignment includes the C-terminus of EgDHAsyn1 (EgDHAsyn1_CT; aa 253-793 of SEQ ID NO:12; the N-terminus of EgDHAsyn1 is not shown and is indicated by ...), EgDHAsyn2 (EgDHAsyn2_CT; aa 253-793 of SEQ ID NO:22, the N-terminus of EgDHAsyn2 is not shown and is indicated by ...), *Euglena gracilis* delta-4 fatty acid desaturase (SEQ ID NO:13), *Thraustochytrium aureum* delta-4 desaturase (SEQ ID NO:27), *Schizochytrium aggregatum* delta-4 desaturase (SEQ ID NO:28), *Thalassiosira pseudonana* delta-4 desaturase (SEQ ID NO:29) and *Isochrysis galbana* delta-4 desaturase (SEQ ID NO:30). The *Euglena*, *Thraustochytrium*, *Thalassiosira* and *Isochrysis* proteins are labeled as EgD4, TaD4, TpD4 and IgD4, respectively.

FIG. 6

EgDHAsyn1_NCT (aa 253-365 of SEQ ID NO:12), EgDHAsyn2_NCT (aa 253-365 of SEQ ID NO:22), EgC20elo1_CT (aa 246-298 of SEQ ID NO:6), PavC20elo_CT (aa 240-277 of SEQ ID NO:2), OtPUFAelo2_CT (aa 256-300 of SEQ ID NO:25), TpPUFAelo2_CT (aa 279-358 of SEQ ID NO:26), EgD4_NT (aa 1-116 of SEQ ID NO:13), TaD4_NT (aa 1-47 of SEQ ID NO:27), SaD4_NT (aa 1-47 of SEQ ID NO:28), TpD4_NT (aa 1-82 of SEQ ID NO:29), IgD4_NT (aa 1-43 of SEQ ID NO:30) is shown.

EaDHAsyn1 is SEQ ID NO:95;
EaDHAsyn2 is SEQ ID NO:96;
EaDHAsyn3 is SEQ ID NO:97;
EaDHAsyn4 is SEQ ID NO:98.

FIG. 18

| Gene | Vector | 16:0 | 16:1 | 17:1 (9) | 18:0 | 18:1 | 18:2 | EPA | DPA | DHA | % C20 Elong | % D4 Desat | Ave. % C20 Elong | Ave. % D4 Desat |
|---|---|---|---|---|---|---|---|---|---|---|---|---|---|---|
| EgDHAsyn1 | pY132-1 | 13.3 | 6.7 | 1.1 | 0.8 | 19.4 | 42.2 | 12.8 | 2.8 | 0.9 | 22.3 | 24.3 | 22.3 | 24.3 |
| EgDHAsyn1 | pY141-1 | 13.3 | 6.5 | 1.2 | 0.8 | 22.0 | 38.1 | 16.2 | 1.5 | 0.4 | 10.5 | 22.6 | 10.5 | 22.6 |
| EgDHAsyn1 | pY161-1 | 13.1 | 6.5 | 1.1 | 0.9 | 20.7 | 41.4 | 15.2 | 1.0 | 0.2 | 7.5 | 16.6 | 7.5 | 16.5 |
|  | pY161-2 | 13.0 | 6.4 | 1.1 | 0.9 | 20.9 | 41.4 | 15.2 | 1.0 | 0.2 | 7.5 | 16.4 |  |  |
| EgDHAsyn2 | pY164-2 | 13.1 | 6.2 | 1.2 | 0.9 | 20.4 | 41.5 | 15.9 | 0.8 | 0.2 | 5.8 | 18.0 | 5.7 | 16.9 |
|  | pY164-3 | 13.1 | 6.3 | 1.1 | 1.1 | 23.5 | 39.2 | 14.8 | 0.7 | 0.1 | 5.6 | 15.8 |  |  |
| EaDHAsyn1 | pY165-1 | 13.2 | 6.2 | 1.1 | 1.0 | 21.7 | 40.7 | 14.9 | 1.0 | 0.2 | 7.4 | 17.0 | 6.4 | 17.4 |
|  | pY165-2 | 13.2 | 6.4 | 1.2 | 0.9 | 23.1 | 36.6 | 17.5 | 0.8 | 0.2 | 5.4 | 17.8 |  |  |
| EaDHAsyn2 | pY166-1 | 13.3 | 6.6 | 1.0 | 1.0 | 24.9 | 37.6 | 14.0 | 1.3 | 0.2 | 9.9 | 14.7 | 9.5 | 16.3 |
|  | pY166-2 | 13.4 | 6.0 | 1.1 | 1.0 | 21.4 | 40.2 | 15.4 | 1.3 | 0.3 | 9.2 | 18.4 |  |  |
|  | pY166-3 | 13.1 | 6.4 | 1.1 | 1.1 | 23.5 | 38.4 | 14.9 | 1.3 | 0.2 | 9.5 | 15.7 |  |  |
| EaDHAsyn3 | pY167-1 | 13.4 | 6.0 | 1.1 | 1.0 | 21.5 | 40.3 | 15.3 | 1.1 | 0.2 | 8.0 | 17.7 | 8.0 | 17.2 |
|  | pY167-2 | 13.2 | 6.1 | 1.1 | 1.0 | 21.0 | 40.7 | 15.5 | 1.1 | 0.2 | 8.0 | 17.5 |  |  |
|  | pY167-3 | 13.0 | 6.5 | 1.1 | 1.0 | 22.6 | 38.6 | 15.9 | 1.2 | 0.2 | 8.1 | 16.4 |  |  |
| EaDHAsyn4 | pY168-1 | 13.0 | 6.2 | 1.1 | 0.9 | 21.9 | 40.5 | 16.2 | 0.2 | 0.0 | 1.0 | 0.0 | 1.1 | 0.0 |
|  | pY168-2 | 12.9 | 6.2 | 1.0 | 1.2 | 25.7 | 34.0 | 18.8 | 0.2 | 0.0 | 1.1 | 0.0 |  |  |
|  | pY168-3 | 13.3 | 6.3 | 1.1 | 1.0 | 23.2 | 39.5 | 15.4 | 0.2 | 0.0 | 1.0 | 0.0 |  |  |

FIG. 19

| Gene | Vector | 16:0 | 16:1 | 17:1 (9) | 18:0 | 18:1 | 18:2 | EPA | DPA | DHA | % C20 Elong | % D4 Desat | Ave. % C20 Elong | Ave. % D4 Desat |
|---|---|---|---|---|---|---|---|---|---|---|---|---|---|---|
| Vector control | pGPD | 11.1 | 6.7 | 1.1 | 1.8 | 52.9 | 12.3 | 13.0 | 0.0 | 0.0 | 0.0 | 0.0 | 0.0 | 0.0 |
| EgDHAsyn1 | pY141-1 | 11.0 | 7.0 | 1.1 | 1.8 | 52.5 | 14.0 | 10.5 | 1.2 | 0.1 | 10.8 | 5.1 | 10.6 | 5.5 |
|  | pY141-2 | 10.9 | 7.1 | 1.1 | 1.8 | 52.7 | 13.9 | 10.5 | 1.2 | 0.1 | 10.8 | 5.0 |  |  |
|  | pY141-3 | 11.1 | 6.6 | 1.2 | 1.7 | 52.0 | 12.6 | 12.6 | 1.3 | 0.1 | 10.2 | 6.5 |  |  |
| EgDHAsyn1C20EloDom1 | pY143-1 | 11.1 | 6.5 | 1.8 | 1.3 | 46.0 | 13.7 | 16.5 | 2.4 | 0.0 | 12.8 | 0.0 | 13.9 | 0.0 |
|  | pY143-2 | 10.9 | 6.8 | 1.1 | 1.7 | 52.2 | 12.5 | 11.8 | 2.3 | 0.0 | 16.4 | 0.0 |  |  |
|  | pY143-3 | 11.1 | 6.0 | 1.5 | 1.6 | 48.4 | 11.6 | 16.8 | 2.4 | 0.0 | 12.3 | 0.0 |  |  |
| EgDHAsyn1C20EloDom2 | pY149-1 | 11.2 | 6.0 | 1.1 | 1.7 | 51.3 | 10.3 | 15.2 | 2.4 | 0.0 | 13.6 | 0.0 | 14.3 | 0.0 |
|  | pY149-2 | 11.0 | 6.7 | 1.1 | 1.8 | 52.3 | 12.0 | 12.5 | 1.8 | 0.0 | 12.6 | 0.0 |  |  |
|  | pY149-3 | 10.9 | 6.4 | 1.1 | 1.9 | 52.5 | 12.3 | 11.6 | 2.3 | 0.0 | 16.6 | 0.0 |  |  |
| EgDHAsyn1C20EloDom3-IgD4 | pY156-1 | 11.0 | 6.9 | 1.0 | 1.9 | 53.6 | 12.3 | 11.7 | 0.7 | 0.0 | 5.9 | 0.0 | 5.3 | 0.0 |
|  | pY156-2 | 11.1 | 5.9 | 1.1 | 1.9 | 52.7 | 11.5 | 14.0 | 0.9 | 0.0 | 5.9 | 0.0 |  |  |
|  | pY156-3 | 11.1 | 6.1 | 1.2 | 1.9 | 52.4 | 11.5 | 14.4 | 0.6 | 0.0 | 4.3 | 0.0 |  |  |
| EgDHAsyn1C20EloDom3-EgD4Dom1 | pY157-1 | 10.9 | 6.6 | 1.1 | 1.8 | 52.8 | 12.2 | 12.2 | 1.5 | 0.1 | 11.8 | 5.6 | 12.0 | 6.3 |
|  | pY157-2 | 10.9 | 6.5 | 1.3 | 1.6 | 49.1 | 14.2 | 13.3 | 2.0 | 0.1 | 13.7 | 6.9 |  |  |
|  | pY157-3 | 10.9 | 6.2 | 1.1 | 1.8 | 52.4 | 11.7 | 13.6 | 1.5 | 0.1 | 10.6 | 6.4 |  |  |
| EgDHAsyn1C20EloDom3-SaD4 | pY160-1 | 10.8 | 5.9 | 1.2 | 1.8 | 51.5 | 12.0 | 13.5 | 2.2 | 0.2 | 15.3 | 9.9 | 15.2 | 9.7 |
|  | pY160-2 | 10.8 | 6.3 | 1.1 | 1.8 | 51.6 | 12.2 | 13.2 | 2.1 | 0.2 | 14.9 | 10.0 |  |  |
|  | pY160-3 | 10.8 | 6.2 | 1.1 | 1.8 | 52.2 | 12.4 | 12.4 | 2.0 | 0.2 | 15.3 | 9.0 |  |  |

FIG. 20

| Gene | Vector | 16:0 | 16:1 | 17:1 (9) | 18:0 | 18:1 | 18:2 | EPA | DPA | DHA | % D4 Desat | Ave. % D4 Desat |
|---|---|---|---|---|---|---|---|---|---|---|---|---|
| Vector control | pGPD | 10.3 | 7.4 | 1.4 | 2.0 | 51.5 | 22.2 | 0.6 | 3.8 | 0.0 | 0.0 | 0.0 |
| EgDHAsyn1 | pY141-1 | 10.5 | 7.7 | 1.2 | 2.2 | 52.8 | 21.8 | 0.4 | 3.0 | 0.1 | 3.1 | 3.0 |
|  | pY141-2 | 10.2 | 7.7 | 1.3 | 2.0 | 51.5 | 22.4 | 0.4 | 3.3 | 0.1 | 2.8 |  |
|  | pY141-3 | 10.4 | 7.4 | 2.2 | 1.9 | 47.1 | 23.7 | 0.5 | 6.1 | 0.2 | 3.0 |  |
| IgD4 | pY150-1 | 11.0 | 7.4 | 1.7 | 2.0 | 49.3 | 23.1 | 0.5 | 4.4 | 0.0 | 0.0 | 0.0 |
|  | pY150-2 | 10.7 | 8.2 | 1.9 | 1.5 | 47.0 | 24.8 | 0.6 | 4.6 | 0.0 | 0.0 |  |
|  | pY150-3 | 10.7 | 7.8 | 1.4 | 2.0 | 49.9 | 23.0 | 0.6 | 3.9 | 0.0 | 0.0 |  |
| SaD4 | pY151-1 | 10.5 | 8.7 | 1.5 | 1.5 | 48.1 | 25.6 | 0.6 | 2.8 | 0.1 | 2.2 | 2.5 |
|  | pY151-2 | 10.8 | 8.0 | 1.9 | 1.7 | 46.1 | 25.0 | 0.6 | 5.3 | 0.1 | 2.6 |  |
|  | pY151-3 | 10.7 | 7.8 | 1.8 | 1.7 | 47.0 | 24.2 | 0.6 | 5.3 | 0.1 | 2.6 |  |
| EgDHAsyn1-D4Dom1 | pY152-1 | 10.7 | 7.6 | 1.4 | 2.1 | 50.2 | 22.8 | 0.6 | 3.7 | 0.0 | 0.0 | 0.0 |
|  | pY152-2 | 11.0 | 8.2 | 2.3 | 1.5 | 45.1 | 26.3 | 0.6 | 4.3 | 0.0 | 0.0 |  |
|  | pY152-3 | 11.0 | 7.2 | 1.3 | 2.4 | 51.9 | 21.5 | 0.5 | 3.4 | 0.0 | 0.0 |  |
| EgDHAsyn1-D4Dom2 | pY153-1 | 10.7 | 8.0 | 2.1 | 1.5 | 46.2 | 25.7 | 0.6 | 4.9 | 0.1 | 1.4 | 1.3 |
|  | pY153-2 | 10.7 | 7.2 | 1.6 | 2.0 | 49.0 | 23.3 | 0.6 | 5.1 | 0.1 | 1.2 |  |
| EgDHAsyn1C20EloDom3-IgD4 | pY156-1 | 10.4 | 7.4 | 1.2 | 2.1 | 52.6 | 21.6 | 0.5 | 3.4 | 0.0 | 0.0 | 0.0 |
|  | pY156-2 | 10.5 | 7.1 | 1.3 | 2.1 | 51.8 | 22.1 | 0.4 | 3.8 | 0.0 | 0.0 |  |
|  | pY156-3 | 10.4 | 7.5 | 1.3 | 2.0 | 52.0 | 21.3 | 0.5 | 4.1 | 0.0 | 0.0 |  |
| EgDHAsyn1C20EloDom3-EgD4Dom1 | pY157-1 | 10.5 | 7.4 | 1.3 | 2.1 | 52.2 | 22.0 | 0.5 | 3.2 | 0.1 | 3.0 | 3.2 |
|  | pY157-2 | 10.3 | 8.2 | 1.5 | 1.6 | 48.5 | 25.3 | 0.5 | 3.4 | 0.1 | 3.7 |  |
|  | pY157-3 | 10.4 | 7.3 | 1.2 | 2.1 | 52.3 | 21.4 | 0.4 | 3.7 | 0.1 | 2.7 |  |
| EgDHAsyn1C20EloDom3-SaD4 | pY160-1 | 10.5 | 7.2 | 1.4 | 2.1 | 52.0 | 22.0 | 0.4 | 3.3 | 0.3 | 7.0 | 6.2 |
|  | pY160-2 | 10.5 | 7.6 | 1.2 | 2.1 | 52.2 | 21.9 | 0.4 | 3.1 | 0.2 | 5.9 |  |
|  | pY160-3 | 10.4 | 7.6 | 1.2 | 2.1 | 52.2 | 22.3 | 0.4 | 2.8 | 0.2 | 5.6 |  |

FIG. 22

| Gene | Sample Name | Fatty Acid | 16:0 | 16:1(9) | 17:1(9) | 18:0 | 18:1 | 18:2 | ARA | EPA | DTA | DPAn-6 | DPA | DHA | % C20 Elong | % D4 Desat | Ave. % C20 Elong | Ave. % D4 Desat |
|---|---|---|---|---|---|---|---|---|---|---|---|---|---|---|---|---|---|---|
| Vector control | | EPA | 11.5 | 5.3 | 1.1 | 1.7 | 47.5 | 16.6 | 0.1 | 16.4 | 0.0 | 0.0 | 0.0 | 0.0 | 0.0 | | | |
| EgDHAsyn1 | 141-1 | EPA | 11.2 | 5.4 | 1.0 | 1.6 | 48.0 | 16.6 | 0.1 | 13.6 | 0.0 | 0.0 | 2.3 | 0.3 | 15.7 | 10.0 | 14.0 | 11.3 |
| | 141-2 | EPA | 12.4 | 4.9 | 1.0 | 1.7 | 40.7 | 17.7 | 0.1 | 18.7 | 0.0 | 0.0 | 2.5 | 0.4 | 13.5 | 14.5 | | |
| | 141-3 | EPA | 11.7 | 5.3 | 0.8 | 1.7 | 45.6 | 16.7 | 0.1 | 15.8 | 0.0 | 0.0 | 2.1 | 0.2 | 12.9 | 9.4 | | |
| Vector control | | ARA | 12.9 | 4.7 | 0.8 | 2.2 | 42.0 | 19.7 | 17.7 | 0.0 | 0.0 | 0.0 | 0.0 | 0.0 | 0.0 | | | |
| EgDHAsyn1 | 141-1 | ARA | 12.7 | 4.7 | 0.8 | 2.2 | 41.8 | 20.1 | 15.4 | 0.0 | 2.0 | 0.3 | 0.0 | 0.0 | 12.9 | 13.0 | 10.6 | 15.1 |
| | 141-2 | ARA | 14.5 | 4.0 | 0.7 | 2.6 | 34.5 | 20.2 | 21.2 | 0.0 | 1.8 | 0.4 | 0.0 | 0.0 | 9.2 | 18.5 | | |
| | 141-3 | ARA | 13.6 | 4.5 | 0.7 | 2.3 | 38.8 | 20.3 | 18.0 | 0.0 | 1.6 | 0.3 | 0.0 | 0.0 | 9.6 | 13.9 | | |
| Vector control | | DPA | 10.7 | 6.3 | 1.1 | 1.7 | 46.5 | 26.7 | 0.0 | 1.0 | 0.0 | 0.0 | 6.0 | 0.0 | 0.0 | 0.0 | | |
| EgDHAsyn1 | 141-1 | DPA | 11.2 | 5.9 | 1.1 | 1.9 | 46.7 | 26.3 | 0.0 | 0.7 | 0.0 | 0.0 | 5.7 | 0.4 | | 6.4 | | 6.5 |
| | 141-2 | DPA | 11.8 | 5.8 | 1.1 | 1.9 | 41.0 | 28.2 | 0.0 | 0.7 | 0.0 | 0.0 | 8.8 | 0.7 | | 7.4 | | |
| | 141-3 | DPA | 11.1 | 6.0 | 0.9 | 1.8 | 44.0 | 27.8 | 0.0 | 0.6 | 0.0 | 0.0 | 7.2 | 0.5 | | 5.9 | | |

FIG. 23

| Sample Name | 16:0 | 18:0 | 18:1 | 18:2 | GLA | 18:3 | EDA | DGLA | ARA | ERA | JUN | ETA | EPA | 22:3 (10,13,16) | DTA | DPA | DHA | % C20 Elong | % D4 Desat |
|---|---|---|---|---|---|---|---|---|---|---|---|---|---|---|---|---|---|---|---|
| AFS4915-5-3-1 | 11.2 | 4.3 | 21.3 | 20.4 | 1.0 | 4.7 | 4.1 | 7.6 | 0.3 | 3.2 | 3.7 | 3.5 | 7.2 | 3.1 | 1.0 | 1.3 | 2.1 | 31.9 | 61.3 |
| AFS4915-5-3-2 | 11.8 | 5.1 | 37.9 | 15.9 | 0.2 | 6.8 | 4.4 | 2.5 | 0.0 | 3.5 | 4.4 | 0.9 | 2.1 | 1.9 | 0.6 | 0.7 | 1.2 | 46.8 | 63.4 |
| AFS4915-5-3-3 | 11.9 | 5.1 | 28.6 | 20.6 | 0.6 | 6.8 | 3.5 | 4.0 | 0.1 | 3.1 | 3.0 | 1.9 | 3.3 | 3.6 | 1.1 | 1.2 | 1.6 | 46.8 | 56.8 |
| AFS4915-5-3-4 | 14.2 | 4.2 | 21.6 | 33.1 | 0.5 | 11.5 | 1.0 | 3.7 | 0.0 | 0.9 | 1.1 | 1.5 | 2.6 | 1.7 | 0.7 | 0.7 | 1.2 | 42.6 | 64.8 |
| AFS4915-5-3-5 | 14.9 | 4.3 | 18.6 | 26.3 | 0.8 | 8.9 | 2.5 | 4.1 | 0.1 | 2.5 | 2.7 | 2.7 | 3.9 | 3.3 | 1.2 | 1.7 | 1.7 | 46.2 | 50.0 |
| AFS4915-5-3-6 | 14.2 | 4.2 | 15.2 | 25.9 | 0.9 | 8.9 | 2.8 | 5.4 | 0.1 | 2.8 | 3.0 | 3.5 | 5.1 | 3.1 | 1.1 | 1.4 | 2.4 | 43.3 | 63.2 |
| AFS4915-5-3-7 | 14.4 | 2.1 | 15.0 | 26.7 | 0.9 | 13.4 | 1.1 | 3.1 | 0.1 | 2.2 | 4.7 | 2.7 | 9.3 | 0.6 | 0.4 | 1.3 | 1.7 | 24.9 | 56.6 |
| AFS4915-5-3-8 | 12.0 | 2.1 | 19.7 | 25.9 | 0.6 | 10.6 | 2.5 | 4.4 | 0.2 | 2.6 | 6.7 | 1.6 | 9.8 | 0.2 | 0.2 | 0.3 | 0.7 | 8.9 | 69.8 |
| AFS4915-5-3-9 | 14.5 | 3.4 | 17.5 | 34.8 | 0.5 | 10.3 | 1.5 | 5.6 | 0.1 | 1.3 | 1.9 | 1.9 | 4.9 | 0.4 | 0.3 | 0.3 | 0.8 | 17.7 | 74.0 |
| AFS4915-5-3-10 | 13.0 | 4.0 | 12.6 | 23.4 | 1.0 | 6.2 | 2.8 | 7.8 | 0.3 | 2.6 | 3.1 | 4.5 | 8.3 | 4.4 | 1.3 | 1.9 | 2.8 | 36.1 | 59.9 |
| Average | 13.2 | 3.9 | 20.8 | 25.3 | 0.7 | 8.8 | 2.6 | 4.8 | 0.1 | 2.5 | 3.4 | 2.5 | 5.6 | 2.2 | 0.8 | 1.1 | 1.6 | 34.5 | 62.0 |

FIG. 24

| Sample Name | 16:0 | 18:0 | 18:1 | 18:2 | 18:3 | EDA | DGLA | ERA | ETA | Total % D9 Elong | Total % D8 Desat | Ave. % D9 Elong | Ave. % D8 Desat |
|---|---|---|---|---|---|---|---|---|---|---|---|---|---|
| MSE2071-6-9-1 | 16.7 | 1.8 | 4.8 | 37.8 | 26.3 | 0.2 | 7.5 | 0.6 | 4.3 | 16.4 | 93.7 | 16.6 | 93.5 |
| MSE2071-6-9-2 | 17.0 | 1.6 | 4.8 | 38.3 | 23.6 | 0.2 | 9.2 | 0.4 | 4.8 | 19.2 | 95.7 | | |
| MSE2071-6-9-3 | 15.7 | 2.0 | 5.4 | 39.4 | 26.1 | 0.3 | 6.5 | 0.6 | 3.9 | 14.8 | 91.5 | | |
| MSE2071-6-9-4 | 16.4 | 1.9 | 6.0 | 39.4 | 23.9 | 0.2 | 7.4 | 0.6 | 4.1 | 16.4 | 93.3 | | |
| MSE2071-6-9-5 | 15.7 | 1.8 | 5.5 | 40.5 | 24.2 | 0.3 | 7.5 | 0.5 | 4.0 | 16.0 | 93.3 | | |
| MSE2071-7-1-1 | 18.0 | 2.4 | 5.7 | 39.7 | 29.0 | 2.8 | 0.0 | 2.4 | 0.0 | 6.9 | 0.0 | 5.8 | 0.0 |
| MSE2071-7-1-2 | 15.4 | 1.8 | 3.8 | 41.9 | 33.1 | 2.0 | 0.0 | 2.0 | 0.0 | 5.1 | 0.0 | | |
| MSE2071-7-1-3 | 16.8 | 2.0 | 4.3 | 39.9 | 32.4 | 2.3 | 0.0 | 2.4 | 0.0 | 6.1 | 0.0 | | |
| MSE2071-7-1-4 | 16.4 | 2.2 | 5.8 | 41.8 | 29.2 | 2.5 | 0.0 | 2.2 | 0.0 | 6.1 | 0.0 | | |
| MSE2071-7-1-5 | 16.5 | 2.2 | 5.8 | 42.5 | 29.3 | 1.9 | 0.0 | 1.7 | 0.0 | 4.8 | 0.0 | | |
| MSE2071-7-5-1 | 15.7 | 3.0 | 9.8 | 41.8 | 24.0 | 3.1 | 0.6 | 1.9 | 0.1 | 8.0 | 12.1 | 6.3 | 16.7 |
| MSE2071-7-5-2 | 15.7 | 2.1 | 6.2 | 42.9 | 28.3 | 2.0 | 0.9 | 1.7 | 0.1 | 6.2 | 21.3 | | |
| MSE2071-7-5-3 | 15.8 | 1.7 | 5.6 | 44.4 | 28.7 | 1.6 | 0.7 | 1.5 | 0.1 | 5.1 | 21.2 | | |
| MSE2071-7-5-4 | 16.9 | 1.6 | 5.0 | 42.3 | 30.3 | 1.7 | 0.6 | 1.6 | 0.1 | 5.1 | 16.6 | | |
| MSE2071-7-5-5 | 18.2 | 2.8 | 5.9 | 42.0 | 25.8 | 2.8 | 0.7 | 1.9 | 0.0 | 7.3 | 12.4 | | |
| MSE2071-7-15-1 | 16.4 | 3.6 | 10.3 | 41.4 | 23.1 | 3.1 | 0.1 | 2.0 | 0.0 | 7.5 | 1.9 | 6.0 | 1.3 |
| MSE2071-7-15-2 | 16.4 | 3.1 | 9.3 | 42.9 | 23.6 | 2.9 | 0.1 | 1.8 | 0.0 | 6.8 | 1.8 | | |
| MSE2071-7-15-3 | 17.1 | 1.8 | 5.3 | 41.4 | 31.2 | 1.6 | 0.0 | 1.5 | 0.0 | 4.2 | 0.0 | | |
| MSE2071-7-15-4 | 16.7 | 2.9 | 7.7 | 43.7 | 25.3 | 2.2 | 0.1 | 1.5 | 0.0 | 5.2 | 1.4 | | |
| MSE2071-7-15-5 | 16.6 | 3.8 | 10.0 | 42.9 | 22.3 | 2.7 | 0.1 | 1.6 | 0.0 | 6.3 | 1.6 | | |
| MSE2071-7-18-1 | 15.8 | 2.5 | 8.9 | 39.2 | 19.4 | 0.4 | 8.7 | 0.7 | 4.3 | 19.5 | 92.3 | 22.1 | 92.7 |
| MSE2071-7-18-2 | 17.3 | 4.3 | 11.8 | 34.1 | 15.3 | 0.5 | 11.4 | 0.7 | 4.7 | 25.9 | 93.3 | | |
| MSE2071-7-18-3 | 17.8 | 4.1 | 10.3 | 34.7 | 17.8 | 0.5 | 9.8 | 0.9 | 4.1 | 22.6 | 90.9 | | |
| MSE2071-7-18-4 | 16.0 | 4.2 | 13.4 | 35.5 | 13.5 | 0.5 | 11.7 | 0.6 | 4.6 | 26.3 | 93.4 | | |
| MSE2071-7-18-5 | 15.5 | 2.0 | 7.7 | 41.1 | 21.4 | 0.3 | 7.5 | 0.5 | 4.0 | 16.5 | 93.4 | | |

FIG. 25

| Name | Clone No. | SEQ ID NO: of full insert | SEQ ID NO: of CDS | SEQ ID NO: of AA | E value via BLASTP | % Identity via Jotun Hein | % Identity via Clustal V | Example No. |
|---|---|---|---|---|---|---|---|---|
| EgC20 elo1 | eeg1c.pk005.p14.f | 4 (1327 bp) | 5 (897 bp) | 6 (298 AA) | 6e-62 vs. Pavlova C20Elo | 45.1% vs. Pavlova C20Elo | 40.4% vs. Pavlova C20Elo | 3 |
| EgDHAsyn1 | eeg1c.pk016.e6.f | 10 (2630 bp) | 11 (2382 bp) | 12 (793 AA) | N-terminus (~AA 16-268): 5e-61 vs. Pavlova C20Elo | 47.8% vs. Pavlova C20Elo | 41.2% vs. Pavlova C20Elo | 4 |
|  |  |  |  |  | C-terminus (~AA 253-793): E value of 0.0 vs. E.gracilis D4 | 98.9% vs. E. gracilis D4 | 98.9% vs. E.gracilis D4 |  |
| EgDHAsyn2 | eeg1c-1 | 20 (2630 bp) | 21 (2382 bp) | 22 (793 AA) | N-terminus (~AA 41-268): E value of 1e-61 | 48.2% vs. Pavlova C20Elo | 41.2% vs. Pavlova C20Elo | 5 |
|  |  |  |  |  | C-terminus (~AA 253-793): E value of 0.0 | 100% vs. E. gracilis D4 | 100% vs. E.gracilis D4 |  |

• "Pavlova C20Elo" = C20-PUFA Elo from Pavlova sp. CCMP459 (SEQ ID NO:2) (NCBI Accession No. AAV33630 (GI 54307108), locus AAV33630, CDS AY630573; Pereira et al., Biochem. J. 384:357-366 (2004)

• "E. gracilis D4" = delta-4 fatty acid desaturase from Euglena gracilis (SEQ ID NO:13) (NCBI Accession No. AAQ19605 (GI 33466346), locus AAQ19605, CDS AY278558; Meyer et al., Biochemistry 42(32):9779-9788 (2003))

FIG. 26

Fatty acid composition (wt.%)

| Event | 16:0 | 18:0 | 18:1 | LA | ALA | EPA | 22:0 | DPA | 24:0 | DHA | 24:1 | % C20/delta-5 elong | % delta-4 desat |
|---|---|---|---|---|---|---|---|---|---|---|---|---|---|
| 5036-2-2 | 21.4 | 5.2 | 16.8 | 32.1 | 16.8 | 2.0 | 1.9 | 1.7 | 1.5 | 0.7 | 0.0 | 54.6 | 28.0 |
| 5036-3-7 | 22.5 | 4.5 | 7.2 | 38.2 | 20.8 | 1.8 | 1.7 | 1.1 | 1.2 | 0.9 | 0.0 | 52.2 | 44.4 |
| 5036-3-8 | 18.0 | 4.6 | 10.3 | 38.6 | 21.5 | 3.3 | 1.9 | 0.0 | 1.4 | 0.4 | 0.0 | 10.6 | 100.0 |
| 5036-7-1 | 27.8 | 6.2 | 11.0 | 30.0 | 16.9 | 2.6 | 2.7 | 0.0 | 1.9 | 0.8 | 0.0 | 24.3 | 100.0 |
| 5036-7-3 | 21.1 | 4.1 | 8.1 | 38.2 | 21.0 | 2.8 | 1.9 | 0.5 | 1.3 | 1.1 | 0.0 | 36.5 | 71.3 |
| 5036-7-4 | 18.0 | 4.6 | 8.0 | 36.6 | 25.1 | 2.4 | 2.1 | 0.3 | 1.6 | 1.2 | 0.0 | 39.1 | 78.4 |
| 5038-1-2 | 21.2 | 5.0 | 8.2 | 35.9 | 22.7 | 1.8 | 2.4 | 0.3 | 1.7 | 0.9 | 0.0 | 40.0 | 74.2 |
| 5038-1-3 | 21.2 | 4.2 | 12.2 | 35.9 | 20.2 | 1.8 | 1.9 | 0.5 | 1.1 | 1.1 | 0.0 | 46.0 | 68.8 |
| 5038-4-1 | 15.7 | 3.8 | 7.9 | 44.1 | 24.6 | 0.9 | 1.0 | 0.3 | 0.8 | 0.8 | 0.0 | 53.3 | 72.0 |
| 5038-1-4 | 29.6 | 7.6 | 9.3 | 25.6 | 19.2 | 1.8 | 2.4 | 0.7 | 1.6 | 2.2 | 0.0 | 62.1 | 74.9 |
| 5038-2-3 | 18.6 | 4.2 | 6.9 | 40.4 | 22.0 | 2.2 | 2.7 | 1.1 | 1.4 | 0.6 | 0.0 | 44.2 | 34.8 |
| 5038-2-7 | 20.6 | 4.9 | 7.5 | 35.8 | 23.9 | 2.0 | 2.5 | 0.5 | 1.6 | 0.7 | 0.0 | 37.4 | 58.3 |
| 5038-2-8 | 21.8 | 5.8 | 8.9 | 32.1 | 23.3 | 2.2 | 2.9 | 0.4 | 2.0 | 0.6 | 0.0 | 31.3 | 61.5 |
| 5038-4-2 | 19.4 | 4.5 | 6.0 | 35.3 | 27.4 | 2.6 | 2.3 | 0.0 | 1.6 | 0.6 | 0.0 | 28.3 | 100.0 |
| 5038-4-4 | 19.7 | 5.0 | 6.9 | 33.8 | 27.2 | 2.3 | 2.5 | 0.0 | 1.8 | 1.0 | 0.0 | 28.4 | 100.0 |
| 5038-4-8 | 18.1 | 3.9 | 5.6 | 38.5 | 26.6 | 2.2 | 2.6 | 0.0 | 1.7 | 0.9 | 0.0 | 28.3 | 100.0 |
| 5038-4-9 | 18.1 | 4.3 | 8.7 | 39.4 | 22.0 | 1.9 | 2.4 | 0.7 | 1.6 | 1.0 | 0.0 | 48.2 | 57.3 |
| 5038-5-3 | 18.2 | 4.0 | 6.8 | 40.2 | 23.8 | 2.0 | 2.4 | 0.5 | 1.5 | 0.6 | 0.0 | 35.6 | 55.6 |
| 5038-5-4 | 18.3 | 4.4 | 7.5 | 36.4 | 24.3 | 2.3 | 3.1 | 0.3 | 1.9 | 1.5 | 0.0 | 44.5 | 83.0 |
| 5038-6-1 | 17.8 | 3.4 | 7.2 | 42.4 | 23.3 | 2.2 | 1.5 | 0.3 | 1.0 | 1.0 | 0.0 | 36.2 | 77.8 |
| 5038-6-2 | 18.6 | 4.4 | 7.3 | 39.8 | 22.2 | 2.9 | 2.3 | 0.2 | 1.5 | 0.9 | 0.0 | 27.4 | 84.7 |
| 5038-7-7 | 19.0 | 3.7 | 8.6 | 40.8 | 21.0 | 2.5 | 1.7 | 0.3 | 1.1 | 1.3 | 0.0 | 39.0 | 80.2 |
| 5035-2-1 | 17.5 | 3.5 | 6.8 | 36.8 | 27.7 | 1.4 | 2.8 | 0.7 | 2.0 | 0.9 | 0.0 | 52.8 | 54.0 |
| 5035-3-1 | 17.1 | 3.8 | 7.5 | 38.1 | 25.5 | 2.7 | 2.7 | 0.0 | 1.8 | 0.9 | 0.0 | 23.8 | 100.0 |
| 5035-3-3 | 20.0 | 4.2 | 7.3 | 33.7 | 24.2 | 1.9 | 3.7 | 1.4 | 2.4 | 1.2 | 0.0 | 57.6 | 46.7 |
| 5035-3-5 | 17.0 | 4.0 | 7.4 | 35.6 | 26.8 | 1.6 | 3.7 | 0.5 | 2.2 | 1.1 | 0.0 | 51.0 | 70.4 |
| 5035-3-6 | 16.3 | 3.4 | 7.9 | 38.5 | 25.2 | 2.2 | 3.4 | 0.0 | 2.1 | 0.9 | 0.0 | 28.1 | 100.0 |
| 5035-6-1 | 20.0 | 4.3 | 5.7 | 33.6 | 29.2 | 2.4 | 2.0 | 0.4 | 1.4 | 1.1 | 0.0 | 38.4 | 75.8 |
| 5035-1-1 | 26.0 | 5.2 | 5.9 | 29.7 | 23.9 | 3.0 | 2.9 | 0.0 | 2.3 | 1.0 | 0.0 | 24.8 | 100.0 |
| 5035-3-8 | 20.4 | 4.3 | 5.6 | 34.7 | 27.4 | 2.3 | 2.6 | 0.0 | 1.6 | 1.1 | 0.0 | 32.3 | 100.0 |
| 5035-3-11 | 27.3 | 5.4 | 6.6 | 30.6 | 23.1 | 1.7 | 2.2 | 0.7 | 1.6 | 0.9 | 0.0 | 48.0 | 55.6 |
| 5035-3-14 | 20.1 | 5.3 | 7.5 | 34.7 | 24.8 | 2.1 | 2.6 | 0.5 | 1.6 | 0.8 | 0.0 | 39.7 | 60.2 |
| 5035-7-3 | 22.3 | 4.9 | 6.1 | 33.8 | 25.8 | 1.1 | 2.4 | 0.9 | 1.6 | 1.1 | 0.0 | 65.2 | 55.4 |

FIG. 29

| Domain | Gene | nt SEQ ID NO: | amino acid SEQ ID NO: | Comments |
|---|---|---|---|---|
| C20 elongase | EaDHAsyn1 | 227 | 231 | EaDHAsyn4 C20 elongase domain – The amino acid sequence is identical to that of EaDHAsyn1. |
| | EaDHAsyn2 | 228 | 232 | |
| | EaDHAsyn3 | 229 | 233 | |
| | EaDHAsyn4 | 230 | - | |
| proline-rich linker | EaDHAsyn1 | 234 | 235 | The nt and amino acid sequence of the proline-rich linker of EaDHAsyn2, EaDHAsyn3 and EaDHAsyn4 are identical to that of EaDHAsyn1. |
| | EaDHAsyn2 | | | |
| | EaDHAsyn3 | | | |
| | EaDHAsyn4 | | | |
| delta-4 desaturase domain 1 | EaDHAsyn1 | 236 | 239 | Delta-4 desaturase domain without proline-rich linker or C20 elongase domain. The nt and amino acid sequence for the delta-4 desaturase domain 1 of EaDHAsyn3 is identical to that for EaDHAsyn1. |
| | EaDHAsyn2 | 237 | 240 | |
| | EaDHAsyn3 | | | |
| | EaDHAsyn4 | 238 | 241 | |
| delta-4 desaturase domain 2 | EaDHAsyn1 | 242 | 246 | Delta-4 desaturase domain including proline-rich linker and a region of the 3' (Cterminal) end of C20 elongase domain. |
| | EaDHAsyn2 | 243 | 247 | |
| | EaDHAsyn3 | 244 | 248 | |
| | EaDHAsyn4 | 245 | 249 | |

FIG. 36

| Event No. | 16:0 | 18:0 | 18:1 | LA | ALA |
|---|---|---|---|---|---|
| Typical wt Embryo | 17.5 | 3.6 | 6.9 | 43.5 | 28.6 |
| 2148-4-12-1 | 15.8 | 3.6 | 12.3 | 53.9 | 14.4 |
| 2148-2-10-1 | 18.0 | 3.7 | 11.5 | 51.1 | 15.7 |
| 2148-2-5-1 | 18.8 | 3.3 | 8.9 | 52.8 | 16.1 |
| 2148-4-13-1 | 16.0 | 3.7 | 13.2 | 50.9 | 16.2 |
| 2148-2-8-1 | 17.5 | 3.4 | 9.6 | 53.2 | 16.3 |
| 2165-4-1-1 | 19.4 | 3.5 | 9.1 | 56.0 | 12.0 |
| 2165-1-13-1 | 18.5 | 3.4 | 10.5 | 55.0 | 12.6 |
| 2165-4-2-1 | 17.1 | 3.0 | 10.0 | 57.2 | 12.7 |
| 2165-1-5-1 | 17.3 | 3.8 | 11.8 | 54.0 | 13.1 |
| 2165-1-2-1 | 18.2 | 4.3 | 9.1 | 54.8 | 13.6 |

FIG. 37

| Event No. | 16:0 | 18:0 | 18:1 | LA | ALA | EDA | DGLA | ERA | ETA |
|---|---|---|---|---|---|---|---|---|---|
| 2144-1-3-1 | 19.1 | 2.1 | 7.6 | 29.9 | 20.2 | 1.8 | 12.2 | 0.9 | 6.2 |
| 2144-1-3-2 | 19.7 | 2.4 | 6.5 | 29.6 | 18.1 | 2.4 | 13.8 | 1.0 | 6.6 |
| 2144-1-3-3 | 18.9 | 2.5 | 7.6 | 29.4 | 16.9 | 4.0 | 13.4 | 1.2 | 6.1 |
| 2144-1-3-4 | 19.2 | 2.9 | 6.3 | 27.4 | 17.0 | 5.1 | 14.2 | 1.5 | 6.4 |
| Ave. | 19.2 | 2.5 | 7.0 | 29.1 | 18.0 | 3.3 | 13.4 | 1.1 | 6.3 |
| 2144-1-7-1 | 18.1 | 1.9 | 8.4 | 33.1 | 18.1 | 2.0 | 12.7 | 0.6 | 5.1 |
| 2144-1-7-2 | 18.7 | 2.2 | 7.9 | 32.3 | 16.8 | 2.1 | 13.9 | 0.7 | 5.4 |
| 2144-1-7-3 | 18.0 | 1.7 | 8.1 | 34.5 | 18.4 | 2.1 | 11.6 | 0.6 | 4.8 |
| 2144-1-7-4 | 18.5 | 2.0 | 7.8 | 33.5 | 18.2 | 2.2 | 12.3 | 0.8 | 4.7 |
| Ave. | 18.3 | 1.9 | 8.1 | 33.3 | 17.9 | 2.1 | 12.6 | 0.7 | 5.0 |
| 2144-1-9-1 | 16.9 | 2.7 | 13.4 | 28.4 | 10.6 | 4.0 | 17.2 | 0.8 | 6.0 |
| 2144-1-9-2 | 18.3 | 2.5 | 8.9 | 28.3 | 16.8 | 4.3 | 13.6 | 1.3 | 5.9 |
| 2144-1-9-3 | 19.7 | 2.4 | 8.7 | 28.5 | 19.2 | 3.9 | 11.0 | 1.4 | 5.2 |
| 2144-1-9-4 | 18.4 | 1.8 | 7.5 | 34.1 | 21.1 | 2.4 | 9.2 | 0.9 | 4.6 |
| Ave. | 18.3 | 2.3 | 9.6 | 29.8 | 16.9 | 3.7 | 12.7 | 1.1 | 5.4 |
| 2144-1-10-1 | 18.2 | 2.9 | 9.1 | 28.7 | 11.0 | 7.2 | 15.8 | 1.3 | 5.8 |
| 2144-1-10-2 | 17.8 | 2.9 | 9.4 | 31.6 | 13.0 | 7.8 | 11.7 | 1.4 | 4.4 |
| 2144-1-10-3 | 18.2 | 2.2 | 8.0 | 34.1 | 16.6 | 3.8 | 11.3 | 1.1 | 4.6 |
| 2144-1-10-4 | 17.9 | 2.0 | 6.6 | 34.9 | 17.5 | 3.1 | 12.1 | 0.9 | 4.9 |
| Ave. | 18.1 | 2.5 | 8.3 | 32.3 | 14.5 | 5.5 | 12.7 | 1.2 | 4.9 |
| 2144-2-3-1 | 18.7 | 1.8 | 7.0 | 30.2 | 16.4 | 2.9 | 16.6 | 0.8 | 5.6 |
| 2144-2-3-2 | 17.8 | 1.5 | 5.9 | 30.5 | 18.0 | 1.8 | 16.9 | 0.6 | 7.0 |
| 2144-2-3-3 | 16.8 | 1.2 | 6.3 | 29.7 | 23.0 | 0.8 | 14.9 | 0.3 | 7.1 |
| 2144-2-3-4 | 17.5 | 1.7 | 7.1 | 31.0 | 18.1 | 2.3 | 15.1 | 0.7 | 6.5 |
| Ave. | 17.7 | 1.5 | 6.6 | 30.3 | 18.9 | 2.0 | 15.9 | 0.6 | 6.5 |

FIG. 38

| | 16:0 | 18:0 | 18:1 | LA | ALA | EDA | SCI | DGLA | ARA | ERA | JUN | ETA | EPA | Other | Total n-3 |
|---|---|---|---|---|---|---|---|---|---|---|---|---|---|---|---|
| AFS 5452-7-4 | 14.3 | 3.9 | 10.7 | 18.4 | 1.6 | 9.2 | 0.4 | 7.6 | 29.0 | 0.4 | 0.0 | 0.2 | 2.1 | 2.1 | 4.3 |
| AFS 5452-5-6 | 16.5 | 3.1 | 13.6 | 17.3 | 2.2 | 8.8 | 3.2 | 3.8 | 25.2 | 0.7 | 0.7 | 0.4 | 2.5 | 2.1 | 6.6 |
| AFS 5452-3-8 | 13.7 | 3.0 | 12.7 | 23.2 | 1.8 | 11.0 | 0.7 | 5.6 | 24.0 | 0.4 | 0.1 | 0.2 | 1.9 | 1.7 | 4.5 |
| AFS 5416-8-4 | 15.3 | 2.5 | 18.1 | 20.3 | 4.7 | 3.3 | 2.6 | 2.7 | 23.1 | 0.4 | 0.4 | 0.1 | 2.9 | 3.5 | 8.6 |
| AFS 5450-4-3 | 14.9 | 2.9 | 17.4 | 21.0 | 2.9 | 7.3 | 0.4 | 5.7 | 22.5 | 0.4 | 0.2 | 0.3 | 1.9 | 2.2 | 5.7 |
| AFS 5425-8-2 | 15.1 | 2.1 | 17.2 | 22.6 | 8.6 | 2.7 | 0.1 | 3.6 | 21.6 | 0.2 | 0.0 | 0.3 | 3.0 | 2.8 | 12.2 |
| AFS 5450-1-7 | 15.1 | 2.8 | 18.0 | 23.5 | 3.2 | 6.3 | 1.2 | 4.0 | 21.3 | 0.3 | 0.0 | 0.1 | 2.2 | 2.0 | 5.8 |
| AFS 5450-8-5 | 15.8 | 2.8 | 17.9 | 18.6 | 4.4 | 6.9 | 1.7 | 5.3 | 21.1 | 0.5 | 0.1 | 0.3 | 2.6 | 2.0 | 7.8 |
| AFS 5425-4-2 | 15.4 | 2.8 | 17.4 | 23.2 | 5.5 | 5.1 | 1.4 | 2.5 | 20.8 | 0.4 | 0.4 | 0.1 | 2.3 | 2.6 | 8.7 |
| AFS 5450-1-1 | 17.3 | 2.6 | 15.2 | 25.3 | 4.9 | 5.3 | 1.6 | 2.9 | 20.0 | 0.4 | 0.3 | 0.1 | 1.7 | 2.3 | 7.6 |
| AFS 5450-3-4 | 15.8 | 2.5 | 14.0 | 25.4 | 4.1 | 9.7 | 2.0 | 2.4 | 19.6 | 0.6 | 0.4 | 0.0 | 2.0 | 1.3 | 7.2 |
| AFS 5425-3-4 | 14.5 | 3.6 | 16.1 | 18.1 | 4.3 | 5.7 | 0.6 | 10.9 | 19.6 | 0.4 | 0.3 | 0.8 | 1.8 | 3.4 | 7.5 |
| AFS 5450-5-2 | 13.9 | 3.3 | 22.0 | 19.0 | 2.1 | 8.8 | 0.3 | 6.4 | 19.2 | 0.5 | 0.3 | 0.3 | 1.4 | 2.5 | 4.6 |
| AFS 5425-4-1 | 14.8 | 3.0 | 18.2 | 22.2 | 6.4 | 6.2 | 0.4 | 4.3 | 19.0 | 0.4 | 0.0 | 0.3 | 2.1 | 2.7 | 9.2 |
| AFS 5425-4-3 | 14.6 | 2.7 | 15.4 | 26.3 | 9.6 | 4.6 | 0.8 | 2.0 | 17.9 | 0.6 | 0.2 | 0.1 | 2.6 | 2.7 | 13.2 |
| AFS 5425-8-1 | 16.2 | 1.7 | 14.7 | 28.4 | 9.2 | 2.1 | 0.1 | 5.2 | 17.1 | 0.2 | 0.0 | 0.4 | 2.2 | 2.4 | 12.1 |
| AFS 5416-8-2 | 14.5 | 3.7 | 18.8 | 22.1 | 5.4 | 5.6 | 1.1 | 3.8 | 17.1 | 0.7 | 0.6 | 0.2 | 3.4 | 3.1 | 10.3 |
| AFS 5416-8-1 | 15.2 | 2.6 | 19.2 | 24.6 | 4.6 | 5.2 | 1.2 | 4.5 | 17.0 | 0.4 | 0.3 | 0.6 | 1.5 | 2.9 | 7.5 |
| AFS 5450-2-7 | 16.0 | 3.2 | 18.4 | 19.9 | 3.1 | 6.3 | 0.8 | 9.8 | 16.8 | 0.3 | 0.2 | 0.7 | 1.6 | 2.9 | 5.8 |
| AFS 5450-3-1 | 14.8 | 3.7 | 16.6 | 21.2 | 6.6 | 9.0 | 1.0 | 3.0 | 15.8 | 1.5 | 0.6 | 0.5 | 4.2 | 1.6 | 13.3 |

FIG. 39

| | 16:0 | 18:0 | 18:1 | LA | ALA | EDA | SCI | DGLA | ARA | ERA | JUN | ETA | EPA | Other | Total n-3 |
|---|---|---|---|---|---|---|---|---|---|---|---|---|---|---|---|
| AFS 5416-8-1-1 | 14.7 | 2.8 | 18.6 | 14.6 | 1.4 | 9.3 | 0.8 | 8.8 | 21.8 | 0.8 | 0.2 | 0.7 | 2.4 | 3.3 | 5.4 |
| AFS 5416-8-1-2 | 16.9 | 1.6 | 22.5 | 16.6 | 3.8 | 4.4 | 3.9 | 1.3 | 21.5 | 0.7 | 1.0 | 2.8 | 0.2 | 2.6 | 8.6 |
| AFS 5416-8-1-3 | 14.5 | 2.2 | 21.6 | 15.4 | 2.1 | 2.5 | 0.3 | 6.9 | 26.8 | 0.3 | 0.1 | 0.5 | 2.8 | 3.9 | 5.8 |
| AFS 5416-8-1-4 | 16.0 | 1.2 | 11.8 | 42.1 | 13.2 | 1.0 | 0.8 | 0.7 | 8.6 | 0.2 | 0.2 | 1.2 | 0.2 | 2.9 | 15.0 |
| AFS 5416-8-1-5 | 13.9 | 3.7 | 17.8 | 17.6 | 1.6 | 7.7 | 0.6 | 6.1 | 25.5 | 0.4 | 0.1 | 0.3 | 2.3 | 2.4 | 4.7 |
| AFS 5416-8-1-6 | 17.1 | 2.3 | 13.4 | 41.5 | 5.6 | 5.6 | 1.3 | 1.7 | 8.0 | 0.4 | 0.4 | 0.0 | 1.1 | 1.6 | 7.4 |
| AFS 5416-8-1-7 | 13.4 | 3.3 | 16.4 | 18.2 | 1.6 | 6.4 | 0.5 | 9.4 | 25.0 | 0.3 | 0.1 | 0.4 | 2.0 | 3.1 | 4.4 |
| AFS 5416-8-1-8 | 17.3 | 2.1 | 18.6 | 26.9 | 9.2 | 3.5 | 1.7 | 2.1 | 12.6 | 0.5 | 0.5 | 0.2 | 1.5 | 3.3 | 12.0 |
| AFS 5416-8-1-9 | 13.0 | 3.7 | 34.4 | 18.0 | 1.7 | 5.7 | 0.2 | 6.3 | 10.5 | 0.4 | 0.1 | 0.3 | 1.6 | 4.0 | 4.1 |
| AFS 5416-8-1-10 | 14.8 | 3.2 | 17.1 | 35.4 | 5.8 | 5.7 | 1.9 | 2.0 | 9.8 | 0.4 | 0.4 | 0.0 | 1.3 | 2.2 | 7.9 |
| AFS 5416-8-1-11 | 15.2 | 2.6 | 19.2 | 24.6 | 4.6 | 5.2 | 1.2 | 4.5 | 17.0 | 0.4 | 0.3 | 0.6 | 1.5 | 2.9 | 7.5 |

FIG. 40

| | 16:0 | 18:0 | 18:1 | LA | ALA | EDA | SCI | DGLA | ARA | ERA | JUN | ETA | EPA | Other | Total n-3 |
|---|---|---|---|---|---|---|---|---|---|---|---|---|---|---|---|
| AFS 5430-6-5 | 16.5 | 1.7 | 12.4 | 12.0 | 3.4 | 1.5 | 0.1 | 11.9 | 29.4 | 0.1 | 0.3 | 0.6 | 3.6 | 6.6 | 7.9 |
| AFS 5430-3-13 | 12.3 | 2.0 | 14.4 | 24.5 | 5.5 | 3.4 | 2.2 | 1.4 | 28.0 | 0.3 | 0.1 | 0.2 | 2.9 | 2.9 | 9.0 |
| AFS 5430-4-7 | 15.4 | 2.4 | 15.3 | 18.1 | 4.9 | 3.3 | 0.7 | 4.3 | 27.6 | 0.5 | 0.2 | 0.4 | 3.7 | 3.3 | 9.6 |
| AFS 5430-7-4 | 16.5 | 2.3 | 14.9 | 18.4 | 5.0 | 3.5 | 0.2 | 5.9 | 25.5 | 0.3 | 0.1 | 1.0 | 3.2 | 3.1 | 9.7 |
| AFS 5430-3-6 | 14.3 | 2.9 | 17.3 | 17.8 | 3.0 | 5.5 | 0.4 | 6.3 | 25.4 | 0.4 | 0.1 | 0.4 | 2.8 | 3.4 | 6.7 |
| AFS 5430-7-5 | 14.9 | 3.3 | 15.3 | 20.0 | 4.6 | 5.5 | 2.2 | 2.7 | 24.9 | 0.5 | 0.6 | 0.2 | 3.0 | 2.3 | 8.9 |
| AFS 5430-4-2 | 16.2 | 2.6 | 16.4 | 19.2 | 3.9 | 4.6 | 1.1 | 3.3 | 24.8 | 0.5 | 0.3 | 0.3 | 3.3 | 3.6 | 8.3 |
| AFS 5430-1-5 | 13.7 | 2.8 | 15.2 | 22.0 | 2.5 | 7.2 | 0.6 | 5.7 | 23.9 | 0.5 | 0.2 | 0.4 | 2.5 | 2.9 | 6.0 |
| AFS 5430-2-7 | 14.2 | 2.9 | 15.0 | 23.8 | 4.2 | 5.8 | 1.3 | 3.2 | 23.8 | 0.5 | 0.3 | 0.2 | 2.8 | 2.0 | 8.0 |
| AFS 5430-7-2 | 14.8 | 3.1 | 21.2 | 16.1 | 3.8 | 4.1 | 0.8 | 4.5 | 23.7 | 0.4 | 0.3 | 0.4 | 3.6 | 3.2 | 8.5 |
| AFS 5430-3-1 | 14.8 | 3.0 | 19.9 | 17.5 | 3.0 | 6.0 | 0.8 | 4.8 | 23.2 | 0.4 | 0.2 | 0.3 | 2.6 | 3.3 | 6.6 |
| AFS 5430-6-2 | 15.8 | 2.7 | 14.4 | 23.4 | 4.6 | 6.5 | 0.7 | 4.0 | 22.8 | 0.4 | 0.2 | 0.3 | 2.3 | 2.0 | 7.7 |
| AFS 5430-3-3 | 13.8 | 2.6 | 18.0 | 21.1 | 4.1 | 4.6 | 0.5 | 7.0 | 22.6 | 0.2 | 0.1 | 0.2 | 1.5 | 3.7 | 6.2 |
| AFS 5430-1-9 | 14.0 | 3.0 | 19.9 | 18.7 | 4.5 | 5.2 | 0.5 | 5.0 | 22.5 | 0.4 | 0.1 | 0.3 | 2.7 | 3.1 | 8.0 |
| AFS 5430-1-2 | 15.3 | 2.7 | 14.7 | 22.0 | 4.8 | 6.3 | 0.6 | 4.1 | 22.5 | 0.6 | 0.2 | 0.4 | 2.9 | 3.0 | 8.9 |
| AFS 5430-1-11 | 14.8 | 2.7 | 18.1 | 19.4 | 2.2 | 6.5 | 0.5 | 6.8 | 22.4 | 0.5 | 0.2 | 0.4 | 2.3 | 3.2 | 5.6 |
| AFS 5430-4-4 | 15.2 | 2.5 | 16.1 | 20.4 | 2.9 | 9.1 | 0.7 | 4.5 | 22.2 | 0.7 | 0.2 | 0.4 | 3.1 | 2.1 | 7.3 |
| AFS 5430-1-17 | 15.5 | 2.6 | 14.2 | 22.5 | 6.1 | 3.8 | 1.2 | 2.2 | 21.8 | 0.6 | 0.4 | 0.2 | 3.5 | 5.5 | 10.8 |
| AFS 5430-3-14 | 14.9 | 3.0 | 16.4 | 20.8 | 5.6 | 4.6 | 2.0 | 3.1 | 21.6 | 0.6 | 0.5 | 0.3 | 3.7 | 3.0 | 10.8 |
| AFS 5430-2-1 | 13.4 | 3.7 | 21.7 | 14.3 | 3.6 | 5.9 | 1.0 | 5.7 | 21.0 | 0.8 | 0.4 | 0.5 | 4.5 | 3.6 | 9.8 |

| Event | Fatty acid composition (wt.%) | | | | | | | | | | | % C20/delta-5 elong | % delta-4 desat |
|---|---|---|---|---|---|---|---|---|---|---|---|---|---|
| | 16:0 | 18:0 | 18:1 | LA | ALA | EPA | 22:0 | DPA | 24:0 | DHA | 24:1 | | |
| 5112-1-1 | 31.0 | 6.9 | 11.2 | 25.6 | 14.9 | 2.7 | 3.4 | 0.2 | 1.7 | 2.4 | 0.0 | 49.2 | 91.9 |
| 5112-1-2 | 24.0 | 5.7 | 10.1 | 32.2 | 17.4 | 2.5 | 3.6 | 0.2 | 2.4 | 1.9 | 0.0 | 45.2 | 89.1 |
| 5112-5-5 | 27.9 | 5.8 | 9.6 | 28.9 | 16.6 | 2.9 | 3.9 | 0.2 | 2.1 | 2.2 | 0.0 | 46.1 | 90.7 |
| 5113-1-2 | 29.6 | 6.7 | 10.8 | 22.4 | 19.2 | 3.2 | 3.1 | 0.3 | 2.0 | 2.5 | 0.0 | 47.1 | 88.0 |
| 5113-1-6 | 27.6 | 6.5 | 11.0 | 24.5 | 17.4 | 3.2 | 4.2 | 0.3 | 2.1 | 3.3 | 0.0 | 52.7 | 92.6 |
| 5113-1-8 | 33.0 | 7.8 | 15.8 | 21.4 | 10.7 | 2.5 | 3.1 | 0.2 | 1.7 | 3.9 | 0.0 | 62.4 | 94.1 |
| 5113-3-1 | 33.1 | 8.4 | 16.1 | 19.0 | 11.2 | 2.9 | 3.4 | 0.1 | 2.0 | 3.8 | 0.0 | 57.7 | 96.2 |
| 5113-3-2 | 26.1 | 6.6 | 13.4 | 28.1 | 14.9 | 3.0 | 3.1 | 0.3 | 1.7 | 2.7 | 0.0 | 49.7 | 90.6 |
| 5113-3-3 | 32.5 | 7.6 | 12.5 | 21.4 | 14.9 | 2.4 | 3.4 | 0.3 | 2.1 | 2.9 | 0.0 | 56.2 | 91.7 |
| 5113-4-3 | 27.8 | 6.3 | 13.2 | 24.6 | 16.4 | 2.8 | 3.2 | 0.2 | 2.1 | 3.3 | 0.0 | 55.5 | 93.2 |
| 5113-4-4 | 23.9 | 6.0 | 12.5 | 28.0 | 18.1 | 3.3 | 3.0 | 0.3 | 2.0 | 2.9 | 0.0 | 49.0 | 91.4 |
| 5113-4-5 | 27.5 | 5.4 | 16.2 | 26.5 | 14.7 | 2.6 | 2.4 | 0.2 | 1.2 | 3.1 | 0.0 | 56.4 | 93.0 |
| 5113-4-9 | 28.0 | 6.2 | 8.6 | 28.3 | 18.5 | 2.7 | 2.8 | 0.3 | 1.8 | 2.8 | 0.0 | 53.0 | 90.8 |
| 5113-4-13 | 27.6 | 6.4 | 9.8 | 29.6 | 16.5 | 2.6 | 2.5 | 0.3 | 2.1 | 2.6 | 0.0 | 53.0 | 88.5 |
| 5113-5-1 | 27.1 | 6.4 | 9.6 | 25.8 | 19.1 | 2.9 | 3.6 | 0.2 | 2.3 | 2.9 | 0.0 | 52.6 | 92.6 |
| 5113-6-1 | 31.3 | 6.7 | 9.0 | 23.7 | 19.0 | 2.6 | 3.0 | 0.3 | 1.9 | 2.5 | 0.0 | 52.5 | 89.1 |
| 5113-6-3 | 28.7 | 7.1 | 9.0 | 26.7 | 17.8 | 2.4 | 3.0 | 0.2 | 2.0 | 3.1 | 0.0 | 57.9 | 94.1 |
| 5113-6-5 | 27.7 | 6.3 | 12.7 | 26.0 | 16.7 | 2.1 | 2.8 | 0.2 | 2.0 | 3.4 | 0.0 | 63.5 | 94.4 |
| 5113-6-7 | 27.9 | 5.4 | 9.2 | 30.5 | 18.7 | 2.1 | 2.2 | 0.3 | 1.4 | 2.4 | 0.0 | 56.6 | 87.7 |
| 5113-6-8 | 28.2 | 6.3 | 9.4 | 26.5 | 18.8 | 2.8 | 3.2 | 0.3 | 2.1 | 2.5 | 0.0 | 49.7 | 89.7 |
| 5113-7-7 | 28.5 | 6.3 | 9.6 | 25.0 | 18.5 | 2.3 | 3.7 | 0.4 | 2.3 | 3.4 | 0.0 | 62.1 | 90.2 |
| 5113-7-9 | 26.4 | 6.3 | 8.8 | 28.7 | 19.6 | 2.3 | 3.1 | 0.3 | 1.9 | 2.6 | 0.0 | 54.9 | 90.9 |
| 5113-7-10 | 30.7 | 6.2 | 8.5 | 24.2 | 18.9 | 2.7 | 3.0 | 0.5 | 2.2 | 3.1 | 0.0 | 56.5 | 86.4 |
| 5116-1-3 | 29.1 | 6.1 | 8.0 | 28.5 | 19.2 | 1.6 | 2.6 | 0.3 | 1.8 | 2.7 | 0.0 | 64.7 | 88.8 |
| 5116-4-2 | 29.2 | 6.0 | 8.2 | 28.7 | 19.7 | 1.9 | 2.2 | 0.3 | 1.5 | 2.3 | 0.0 | 58.1 | 87.8 |
| 5116-5-1 | 29.4 | 6.4 | 10.7 | 29.8 | 16.5 | 1.2 | 2.5 | 0.3 | 1.4 | 1.8 | 0.0 | 63.4 | 87.9 |
| 5116-6-3 | 24.7 | 5.7 | 9.0 | 33.7 | 19.8 | 1.5 | 2.0 | 0.3 | 1.4 | 1.9 | 0.0 | 59.2 | 86.5 |
| 5111-2-1 | 35.1 | 7.7 | 9.4 | 18.5 | 13.9 | 2.5 | 6.1 | 0.0 | 4.1 | 2.7 | 0.0 | 52.1 | 100.0 |
| 5111-3-1 | 32.4 | 7.2 | 14.3 | 19.0 | 12.9 | 2.0 | 4.8 | 0.0 | 3.1 | 4.3 | 0.0 | 68.6 | 100.0 |
| 5111-3-2 | 28.4 | 6.7 | 14.9 | 23.0 | 14.4 | 2.1 | 4.5 | 0.0 | 3.0 | 2.9 | 0.0 | 58.1 | 100.0 |
| 5111-3-3 | 33.1 | 7.6 | 17.0 | 19.0 | 11.2 | 2.5 | 4.3 | 0.0 | 2.0 | 3.4 | 0.0 | 57.9 | 100.0 |
| 5111-3-4 | 36.1 | 7.6 | 18.4 | 17.1 | 10.4 | 2.4 | 3.2 | 0.0 | 1.9 | 2.8 | 0.0 | 53.8 | 100.0 |
| 5111-3-6 | 30.7 | 7.4 | 13.2 | 21.6 | 15.2 | 2.1 | 4.1 | 0.0 | 2.3 | 3.3 | 0.0 | 61.6 | 100.0 |
| 5111-3-7 | 33.8 | 6.0 | 12.0 | 23.3 | 14.8 | 2.5 | 3.2 | 0.0 | 1.8 | 2.7 | 0.0 | 51.8 | 100.0 |
| '5111-7-2 | 31.6 | 6.8 | 11.6 | 23.8 | 16.3 | 2.2 | 3.2 | 0.0 | 1.9 | 2.7 | 0.0 | 55.8 | 100.0 |
| '5112-2-6 | 23.3 | 4.9 | 18.9 | 27.2 | 18.1 | 1.6 | 2.0 | 0.0 | 1.5 | 2.5 | 0.0 | 60.4 | 100.0 |
| '5111-2-3 | 33.2 | 7.5 | 13.5 | 24.3 | 13.5 | 0.9 | 3.1 | 0.0 | 2.0 | 2.0 | 0.0 | 67.8 | 100.0 |
| '5111-3-9 | 21.1 | 6.1 | 14.7 | 34.1 | 18.7 | 1.0 | 1.2 | 0.2 | 0.8 | 2.1 | 0.0 | 69.7 | 89.8 |
| '5111-3-11 | 29.3 | 8.9 | 19.6 | 21.8 | 12.7 | 0.6 | 3.0 | 0.2 | 1.7 | 2.2 | 0.0 | 79.6 | 92.1 |
| '5111-3-14 | 24.9 | 6.4 | 12.1 | 30.3 | 19.4 | 1.3 | 2.3 | 0.0 | 1.7 | 1.7 | 0.0 | 56.6 | 100.0 |
| '5111-4-12 | 30.7 | 7.0 | 17.4 | 22.1 | 15.2 | 1.3 | 2.0 | 0.3 | 1.2 | 2.9 | 0.0 | 70.2 | 91.1 |
| '5111-4-13 | 26.3 | 5.1 | 10.1 | 32.6 | 18.7 | 1.2 | 2.5 | 0.3 | 1.5 | 1.8 | 0.0 | 63.9 | 86.3 |
| '5111-5-4 | 25.9 | 6.0 | 9.6 | 32.8 | 18.7 | 1.1 | 2.5 | 0.3 | 1.7 | 1.6 | 0.0 | 62.7 | 84.9 |
| '5111-5-8 | 31.1 | 7.0 | 10.8 | 27.9 | 15.4 | 1.2 | 2.5 | 0.4 | 1.9 | 1.8 | 0.0 | 64.9 | 82.8 |

Fatty acid composition (wt.%)

| Event | 16:0 | 18:0 | 18:1 | LA | ALA | EPA | 22:0 | DPA | 24:0 | DHA | 24:1 | % C20/delta-5 elong | % delta-4 desat |
|---|---|---|---|---|---|---|---|---|---|---|---|---|---|
| 5037-5-8 | 30.0 | 6.5 | 9.3 | 25.2 | 18.6 | 3.9 | 3.1 | 0.0 | 2.4 | 0.9 | 0.0 | 18.9 | 100.0 |
| 5037-3-2 | 16.0 | 4.6 | 7.2 | 35.5 | 27.0 | 2.2 | 3.7 | 0.3 | 2.4 | 1.2 | 0.0 | 41.3 | 81.3 |
| 5037-3-4 | 15.9 | 4.5 | 8.7 | 36.0 | 25.5 | 2.2 | 3.6 | 0.2 | 2.6 | 0.9 | 0.0 | 34.0 | 80.2 |
| 5037-3-8 | 22.5 | 4.5 | 12.7 | 32.6 | 18.4 | 2.6 | 2.1 | 0.6 | 1.4 | 2.1 | 0.6 | 50.7 | 78.9 |
| 5037-5-12 | 20.9 | 4.3 | 12.7 | 33.7 | 20.2 | 2.3 | 1.8 | 0.9 | 1.3 | 1.8 | 0.0 | 53.8 | 67.9 |
| 5037-5-9 | 40.9 | 8.3 | 10.4 | 18.3 | 13.3 | 1.4 | 3.0 | 0.6 | 2.5 | 1.2 | 0.0 | 57.4 | 66.8 |
| 5037-5-11 | 26.1 | 5.3 | 10.1 | 29.5 | 18.3 | 1.9 | 3.7 | 1.2 | 2.4 | 1.5 | 0.0 | 59.4 | 55.5 |
| 5037-5-7 | 16.0 | 4.6 | 8.5 | 40.4 | 22.0 | 2.8 | 1.9 | 1.2 | 1.3 | 1.1 | 0.2 | 44.8 | 48.9 |

FIG. 50
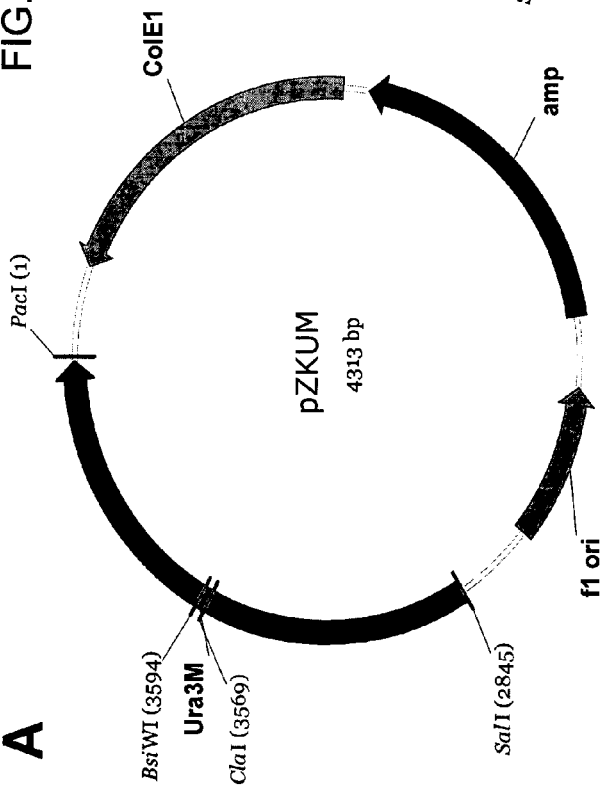
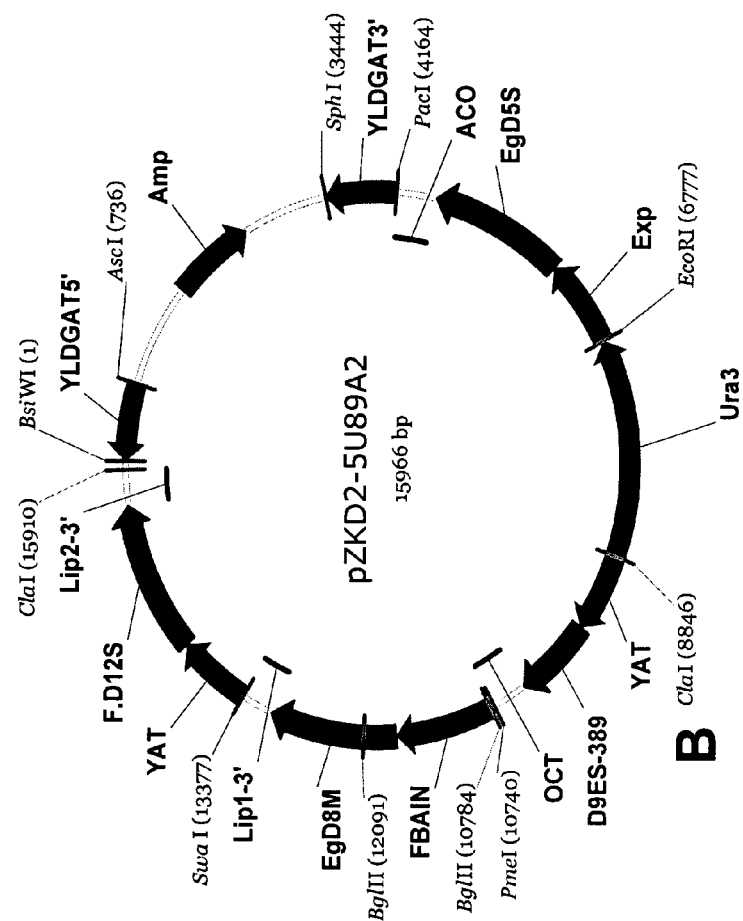

FIG. 53A

N-terminus of EaD4S (SEQ ID NO:193), EaD4S-1 (SEQ ID NO:382), EaD4S-2 (SEQ ID NO:384) and EaD4S-3 (SEQ ID NO:386) aligned.

FIG. 53B

N-terminus of EgD4S (SEQ ID NO:388), EgD4S-1 (SEQ ID NO:404), EgD4S-2 (SEQ ID NO:406) and EgD4S-3 (SEQ ID NO:408) aligned.

| Event | Fatty acid composition (wt.%) | | | | | | | | | C18 % delta-9 elong | C20 % delta-8 desat |
|---|---|---|---|---|---|---|---|---|---|---|---|
| | 16:0 | 18:0 | 18:1 | LA | ALA | EDA | DGLA | ERA | ETA | | |
| 2024-2-11-1 | 20.3 | 6.6 | 16.3 | 29.6 | 12.3 | 4.9 | 6.7 | 1.0 | 2.4 | 26.3 | 60.7 |
| 2024-2-11-2 | 17.1 | 4.8 | 21.7 | 28.7 | 12.1 | 4.8 | 7.4 | 0.7 | 2.7 | 27.7 | 64.7 |
| 2024-2-11-3 | 18.3 | 5.1 | 17.7 | 30.7 | 13.6 | 4.5 | 6.7 | 0.9 | 2.5 | 24.8 | 63.3 |
| 2024-2-11-4 | 18.9 | 5.0 | 13.2 | 32.5 | 14.7 | 5.0 | 7.2 | 0.9 | 2.7 | 25.0 | 62.6 |
| 2024-2-11-5 | 21.1 | 5.9 | 17.5 | 29.1 | 11.5 | 5.4 | 6.2 | 1.0 | 2.3 | 26.7 | 57.2 |
| 2024-2-11-6 | 19.5 | 6.2 | 17.7 | 29.7 | 11.9 | 5.7 | 6.5 | 0.8 | 2.1 | 26.7 | 57.0 |
| Avg. | 19.2 | 5.6 | 17.3 | 30.1 | 12.7 | 5.0 | 6.8 | 0.9 | 2.4 | 26.2 | 60.9 |
| | | | | | | | | | | | |
| 2024-3-5-1 | 16.9 | 4.9 | 17.2 | 23.2 | 7.5 | 11.8 | 13.2 | 1.7 | 3.8 | 49.8 | 55.7 |
| 2024-3-5-2 | 17.1 | 5.3 | 24.1 | 23.2 | 9.3 | 8.1 | 9.0 | 1.2 | 2.7 | 39.2 | 55.6 |
| 2024-3-5-3 | 15.3 | 6.1 | 34.5 | 16.6 | 6.0 | 7.8 | 9.7 | 1.0 | 3.0 | 48.8 | 59.1 |
| 2024-3-5-4 | 17.4 | 7.2 | 24.5 | 20.8 | 6.5 | 9.0 | 10.7 | 1.3 | 2.5 | 46.3 | 55.9 |
| 2024-3-5-5 | 17.6 | 6.6 | 22.5 | 22.1 | 8.8 | 8.3 | 9.8 | 1.5 | 2.8 | 42.1 | 56.1 |
| 2024-3-5-6 | 17.0 | 6.7 | 23.2 | 19.8 | 6.1 | 10.7 | 11.9 | 1.4 | 3.2 | 51.2 | 55.5 |
| Avg. | 16.9 | 6.1 | 24.3 | 20.9 | 7.4 | 9.3 | 10.7 | 1.4 | 3.0 | 46.2 | 56.3 |
| | | | | | | | | | | | |
| 2024-3-9-1 | 16.9 | 5.1 | 24.7 | 16.5 | 6.2 | 11.2 | 14.1 | 1.5 | 3.7 | 57.5 | 58.3 |
| 2024-3-9-2 | 16.2 | 5.2 | 19.9 | 20.0 | 6.1 | 11.5 | 16.0 | 1.3 | 3.9 | 55.6 | 60.8 |
| 2024-3-9-3 | 16.4 | 5.6 | 25.3 | 17.1 | 5.7 | 10.4 | 14.3 | 1.4 | 3.8 | 56.7 | 60.5 |
| 2024-3-9-4 | 16.3 | 5.5 | 28.7 | 15.9 | 6.4 | 9.2 | 13.1 | 1.3 | 3.7 | 55.1 | 61.4 |
| 2024-3-9-5 | 15.8 | 6.4 | 27.6 | 14.2 | 5.5 | 10.3 | 15.2 | 1.3 | 3.7 | 60.7 | 62.1 |
| 2024-3-9-6 | 16.3 | 5.0 | 22.2 | 17.9 | 5.6 | 11.8 | 15.9 | 1.4 | 3.8 | 58.4 | 59.9 |
| Avg. | 16.3 | 5.5 | 24.7 | 16.9 | 5.9 | 10.7 | 14.8 | 1.4 | 3.8 | 57.3 | 60.5 |
| | | | | | | | | | | | |
| 2024-3-11-1 | 17.9 | 6.5 | 24.3 | 22.9 | 7.9 | 8.1 | 9.1 | 1.0 | 2.3 | 40.0 | 55.5 |
| 2024-3-11-2 | 16.0 | 6.2 | 29.6 | 20.5 | 6.4 | 9.4 | 8.3 | 1.2 | 2.3 | 44.0 | 49.9 |
| 2024-3-11-3 | 18.1 | 7.6 | 24.5 | 18.9 | 5.4 | 9.7 | 11.9 | 1.1 | 2.9 | 51.3 | 57.9 |
| 2024-3-11-4 | 16.3 | 6.5 | 27.0 | 21.7 | 6.7 | 8.2 | 9.8 | 1.1 | 2.5 | 43.2 | 56.7 |
| 2024-3-11-5 | 16.0 | 6.4 | 28.5 | 19.8 | 6.3 | 8.3 | 10.8 | 1.1 | 2.8 | 46.8 | 59.3 |
| 2024-3-11-6 | 17.2 | 7.2 | 29.1 | 19.3 | 5.4 | 8.3 | 9.9 | 1.1 | 2.5 | 46.8 | 56.8 |
| Avg. | 16.9 | 6.7 | 27.2 | 20.5 | 6.4 | 8.7 | 10.0 | 1.1 | 2.5 | 45.3 | 56.0 |
| | | | | | | | | | | | |
| 2024-3-15-1 | 16.9 | 4.3 | 15.7 | 28.9 | 11.0 | 6.9 | 11.5 | 1.1 | 3.4 | 36.5 | 65.0 |
| 2024-3-15-2 | 15.8 | 4.2 | 19.5 | 27.4 | 7.9 | 7.5 | 13.5 | 0.7 | 3.1 | 41.3 | 66.8 |
| 2024-3-15-3 | 19.3 | 7.0 | 19.3 | 22.8 | 9.1 | 11.4 | 6.5 | 2.9 | 1.7 | 41.4 | 36.5 |
| 2024-3-15-4 | 16.9 | 3.7 | 9.6 | 30.2 | 13.2 | 7.4 | 13.4 | 2.0 | 3.2 | 37.5 | 63.7 |
| 2024-3-15-5 | 17.0 | 4.5 | 12.9 | 29.8 | 13.6 | 6.9 | 10.6 | 1.8 | 2.8 | 33.7 | 60.6 |
| 2024-3-15-6 | 17.7 | 5.5 | 20.4 | 25.2 | 10.7 | 5.4 | 10.7 | 1.0 | 3.2 | 36.0 | 68.7 |
| Avg. | 17.3 | 4.9 | 16.2 | 27.4 | 10.9 | 7.6 | 11.0 | 1.6 | 2.9 | 37.7 | 60.2 |

FIG. 65

| Event | Fatty acid composition (wt.%) | | | | | | | | | C18 % delta-9 elong | C20 % delta-8 desat |
|---|---|---|---|---|---|---|---|---|---|---|---|
| | 16:0 | 18:0 | 18:1 | LA | ALA | EDA | DGLA | ERA | ETA | | |
| 2136-1-3-1 | 17.7 | 4.2 | 12.0 | 30.3 | 12.0 | 8.8 | 10.2 | 1.0 | 3.1 | 35.3 | 57.8 |
| 2136-1-3-2 | 17.7 | 3.6 | 11.3 | 25.9 | 9.3 | 10.7 | 15.4 | 1.3 | 4.4 | 47.4 | 62.2 |
| 2136-1-3-3 | 17.8 | 3.8 | 9.1 | 25.2 | 9.3 | 10.3 | 17.4 | 1.3 | 5.0 | 49.6 | 65.9 |
| 2136-1-3-4 | 18.9 | 4.5 | 8.2 | 32.3 | 20.6 | 3.4 | 7.5 | 0.7 | 2.1 | 20.6 | 70.2 |
| 2136-1-3-5 | 17.9 | 4.0 | 14.4 | 27.1 | 10.5 | 8.4 | 12.5 | 0.9 | 3.8 | 40.5 | 63.6 |
| Avg. | 18.0 | 4.0 | 11.0 | 28.2 | 12.3 | 8.3 | 12.6 | 1.0 | 3.7 | 38.7 | 64.0 |
| 2136-2-8-1 | 17.0 | 3.8 | 12.1 | 25.7 | 9.7 | 11.6 | 13.9 | 1.3 | 4.5 | 46.9 | 58.8 |
| 2136-2-8-2 | 17.1 | 4.0 | 9.7 | 22.6 | 7.5 | 11.4 | 22.3 | 1.0 | 4.4 | 56.5 | 68.3 |
| 2136-2-8-3 | 18.3 | 3.6 | 9.0 | 25.9 | 10.9 | 10.6 | 14.8 | 1.5 | 4.7 | 46.2 | 61.7 |
| 2136-2-8-4 | 18.5 | 3.5 | 9.3 | 25.1 | 11.6 | 9.7 | 15.2 | 1.5 | 4.9 | 46.0 | 64.2 |
| 2136-2-8-5 | 18.8 | 3.9 | 11.0 | 24.6 | 12.4 | 8.4 | 13.8 | 1.3 | 4.8 | 43.3 | 65.8 |
| Avg. | 17.9 | 3.8 | 10.2 | 24.8 | 10.4 | 10.3 | 16.0 | 1.3 | 4.7 | 47.8 | 63.8 |
| 2136-2-15-1 | 16.7 | 3.0 | 14.7 | 28.9 | 9.6 | 8.9 | 12.9 | 0.8 | 4.2 | 41.1 | 63.7 |
| 2136-2-15-2 | 16.5 | 3.1 | 12.0 | 30.2 | 12.3 | 8.0 | 12.5 | 1.0 | 4.1 | 37.6 | 65.0 |
| 2136-2-15-3 | 16.7 | 3.3 | 13.4 | 29.2 | 8.4 | 9.8 | 14.0 | 0.9 | 4.0 | 43.3 | 62.8 |
| 2136-2-15-4 | 17.8 | 3.4 | 13.3 | 27.6 | 12.5 | 7.5 | 11.8 | 1.1 | 4.5 | 38.3 | 65.5 |
| 2136-2-15-5 | 16.6 | 3.3 | 15.3 | 28.3 | 8.8 | 9.2 | 13.6 | 0.8 | 3.7 | 42.4 | 63.4 |
| Avg. | 16.9 | 3.2 | 13.7 | 28.9 | 10.3 | 8.7 | 13.0 | 0.9 | 4.1 | 40.5 | 64.1 |
| 2136-3-8-1 | 18.1 | 2.9 | 8.5 | 29.4 | 12.7 | 8.2 | 13.3 | 1.5 | 5.0 | 39.9 | 65.5 |
| 2136-3-8-2 | 20.1 | 3.1 | 6.6 | 39.3 | 28.2 | 0.7 | 0.6 | 0.3 | 0.4 | 2.9 | 52.3 |
| 2136-3-8-3 | 19.8 | 3.3 | 7.1 | 27.9 | 15.3 | 7.2 | 12.0 | 1.7 | 4.9 | 37.4 | 65.4 |
| 2136-3-8-4 | 19.2 | 3.6 | 9.1 | 25.9 | 13.1 | 7.9 | 13.0 | 1.8 | 5.6 | 42.1 | 65.8 |
| 2136-3-8-5 | 16.6 | 3.2 | 9.2 | 29.8 | 11.8 | 9.2 | 13.6 | 1.6 | 4.6 | 41.1 | 62.8 |
| Avg. | 18.7 | 3.2 | 8.1 | 30.5 | 16.2 | 6.6 | 10.5 | 1.4 | 4.1 | 32.7 | 62.4 |
| 2136-4-2-1 | 18.6 | 5.0 | 12.6 | 26.1 | 11.9 | 8.6 | 11.2 | 1.3 | 4.0 | 39.7 | 60.6 |
| 2136-4-2-2 | 16.8 | 3.8 | 9.4 | 25.9 | 9.6 | 11.2 | 15.7 | 1.8 | 5.3 | 48.9 | 61.8 |
| 2136-4-2-3 | 17.0 | 3.8 | 8.6 | 26.6 | 10.5 | 10.5 | 15.5 | 1.7 | 5.3 | 46.9 | 63.1 |
| 2136-4-2-4 | 16.8 | 3.0 | 9.0 | 26.3 | 11.2 | 11.1 | 15.1 | 1.8 | 5.3 | 47.0 | 61.3 |
| 2136-4-2-5 | 17.0 | 2.9 | 6.0 | 44.1 | 29.4 | 0.2 | 0.0 | 0.0 | 0.0 | 0.3 | 0.0 |
| Avg. | 17.2 | 3.7 | 9.1 | 29.8 | 14.5 | 8.3 | 11.5 | 1.3 | 4.0 | 36.6 | 49.3 |

FIG. 66

| Event | Fatty acid composition (wt.%) | | | | | | | | | C18 % delta-9 elong | C20 % delta-8 desat |
|---|---|---|---|---|---|---|---|---|---|---|---|
| | 16:0 | 18:0 | 18:1 | LA | ALA | EDA | DGLA | ERA | ETA | | |
| 2131-2-9-1 | 15.4 | 4.0 | 19.9 | 27.7 | 6.8 | 8.5 | 13.4 | 0.8 | 3.0 | 42.7 | 63.7 |
| 2131-2-9-2 | 17.0 | 3.6 | 10.5 | 29.9 | 10.9 | 7.7 | 15.1 | 1.4 | 3.5 | 40.4 | 67.1 |
| 2131-2-9-3 | 16.8 | 3.7 | 9.4 | 26.2 | 9.2 | 8.7 | 19.5 | 1.4 | 4.5 | 49.0 | 70.5 |
| 2131-2-9-4 | 16.2 | 3.7 | 14.7 | 29.2 | 8.8 | 8.0 | 14.6 | 0.9 | 3.3 | 41.4 | 66.9 |
| 2131-2-9-5 | 16.9 | 3.8 | 12.5 | 27.9 | 9.5 | 8.9 | 14.8 | 1.3 | 3.6 | 43.4 | 64.4 |
| Avg. | 16.5 | 3.8 | 13.4 | 28.2 | 9.0 | 8.3 | 15.5 | 1.2 | 3.6 | 43.4 | 66.5 |
| 2131-2-15-1 | 16.0 | 3.9 | 13.3 | 29.1 | 7.4 | 8.6 | 16.0 | 1.0 | 4.1 | 44.9 | 67.5 |
| 2131-2-15-2 | 15.4 | 3.4 | 10.3 | 27.3 | 5.6 | 11.6 | 20.6 | 1.4 | 4.1 | 53.4 | 65.5 |
| 2131-2-15-3 | 16.9 | 3.8 | 13.7 | 28.6 | 8.2 | 8.9 | 14.7 | 1.0 | 3.6 | 43.3 | 64.9 |
| 2131-2-15-4 | 17.3 | 3.2 | 6.6 | 22.2 | 10.3 | 6.5 | 24.1 | 1.7 | 7.3 | 54.9 | 79.3 |
| 2131-2-15-5 | 14.6 | 3.7 | 11.0 | 26.0 | 6.0 | 8.9 | 22.3 | 1.6 | 5.2 | 54.2 | 72.4 |
| Avg. | 16.0 | 3.6 | 11.0 | 26.6 | 7.5 | 8.9 | 19.5 | 1.3 | 4.8 | 50.2 | 69.9 |
| 2131-2-22-1 | 16.2 | 4.7 | 6.5 | 17.5 | 4.8 | 15.1 | 24.7 | 3.0 | 6.2 | 68.7 | 63.0 |
| 2131-2-22-2 | 17.3 | 4.9 | 7.0 | 24.2 | 9.7 | 12.5 | 16.4 | 2.6 | 4.4 | 51.5 | 58.0 |
| 2131-2-22-3 | 17.3 | 5.1 | 9.5 | 20.7 | 6.5 | 14.6 | 18.7 | 2.4 | 4.3 | 59.5 | 57.5 |
| 2131-2-22-4 | 18.7 | 5.2 | 7.4 | 18.5 | 5.4 | 12.3 | 23.9 | 2.0 | 5.6 | 64.8 | 67.4 |
| 2131-2-22-5 | 18.4 | 5.0 | 8.6 | 18.0 | 5.6 | 11.1 | 24.3 | 2.0 | 5.8 | 64.8 | 69.6 |
| Avg. | 17.6 | 5.0 | 7.8 | 19.8 | 6.4 | 13.1 | 21.6 | 2.4 | 5.3 | 61.9 | 63.1 |
| 2131-2-24-1 | 17.0 | 4.0 | 5.3 | 19.3 | 8.1 | 11.6 | 21.6 | 3.7 | 8.0 | 62.1 | 65.9 |
| 2131-2-24-2 | 17.4 | 4.1 | 6.4 | 19.8 | 5.8 | 9.0 | 26.8 | 2.0 | 7.6 | 63.9 | 75.8 |
| 2131-2-24-3 | 16.0 | 4.2 | 6.3 | 23.0 | 6.6 | 16.8 | 17.5 | 3.8 | 4.8 | 59.2 | 52.0 |
| 2131-2-24-4 | 18.0 | 5.9 | 8.4 | 17.2 | 5.6 | 7.9 | 26.4 | 1.7 | 7.6 | 65.7 | 78.0 |
| 2131-2-24-5 | 18.1 | 4.8 | 7.3 | 18.0 | 5.9 | 8.1 | 26.5 | 2.1 | 8.0 | 65.2 | 77.1 |
| Avg. | 17.3 | 4.6 | 6.7 | 19.5 | 6.4 | 10.7 | 23.8 | 2.6 | 7.2 | 63.2 | 69.8 |
| 2131-6-14-1 | 17.5 | 4.1 | 17.3 | 21.0 | 7.8 | 8.1 | 17.4 | 1.1 | 5.0 | 52.4 | 70.9 |
| 2131-6-14-2 | 17.5 | 4.7 | 16.4 | 26.4 | 8.5 | 8.3 | 13.1 | 1.2 | 3.1 | 42.4 | 63.2 |
| 2131-6-14-3 | 17.2 | 3.2 | 12.3 | 22.4 | 9.1 | 10.2 | 18.1 | 1.7 | 5.4 | 52.9 | 66.5 |
| 2131-6-14-4 | 18.1 | 3.6 | 10.9 | 24.6 | 9.1 | 7.7 | 19.6 | 1.0 | 4.8 | 49.7 | 73.6 |
| 2131-6-14-5 | 16.6 | 3.8 | 13.6 | 26.3 | 8.9 | 8.1 | 17.0 | 1.0 | 4.4 | 46.5 | 70.1 |
| Avg. | 17.4 | 3.9 | 14.1 | 24.1 | 8.7 | 8.5 | 17.1 | 1.2 | 4.6 | 48.8 | 68.8 |

FIG. 67

| Event | Fatty acid composition (wt.%) | | | | | | | | | C18 % delta-9 elong | C20 % delta-8 desat |
|---|---|---|---|---|---|---|---|---|---|---|---|
| | 16:0 | 18:0 | 18:1 | LA | ALA | EDA | DGLA | ERA | ETA | | |
| 2130-1-29-1 | 17.5 | 3.4 | 10.8 | 23.7 | 5.6 | 17.4 | 15.0 | 2.2 | 3.8 | 56.7 | 49.0 |
| 2130-1-29-2 | 16.9 | 3.9 | 11.5 | 24.1 | 6.6 | 15.3 | 14.9 | 2.0 | 4.2 | 54.3 | 52.5 |
| 2130-1-29-3 | 17.4 | 3.7 | 11.1 | 22.3 | 6.1 | 17.0 | 14.5 | 2.6 | 4.5 | 57.6 | 49.2 |
| 2130-1-29-4 | 17.8 | 3.8 | 10.5 | 21.8 | 5.7 | 17.1 | 16.0 | 2.4 | 4.4 | 59.1 | 51.1 |
| 2130-1-29-5 | 17.2 | 4.2 | 9.8 | 23.1 | 6.6 | 15.9 | 14.5 | 2.9 | 5.0 | 56.3 | 50.9 |
| Avg. | 17.4 | 3.8 | 10.7 | 23.0 | 6.1 | 16.5 | 15.0 | 2.4 | 4.4 | 56.8 | 50.5 |
| 2130-1-43-1 | 17.5 | 2.9 | 6.9 | 45.5 | 26.3 | 0.4 | 0.0 | 0.1 | 0.0 | 0.6 | 0.0 |
| 2130-1-43-2 | 18.0 | 3.4 | 7.5 | 24.3 | 7.2 | 11.8 | 20.2 | 1.5 | 5.5 | 55.3 | 65.8 |
| 2130-1-43-3 | 20.7 | 5.5 | 12.3 | 23.8 | 5.6 | 11.2 | 15.1 | 1.2 | 3.9 | 51.7 | 60.4 |
| 2130-1-43-4 | 18.3 | 4.0 | 8.7 | 23.6 | 7.8 | 12.1 | 17.2 | 1.9 | 5.5 | 53.9 | 61.8 |
| 2130-1-43-5 | 23.9 | 7.6 | 16.1 | 17.7 | 4.5 | 10.6 | 13.9 | 1.3 | 3.9 | 57.2 | 59.9 |
| Avg. | 19.7 | 4.7 | 10.3 | 27.0 | 10.3 | 9.2 | 13.3 | 1.2 | 3.8 | 43.7 | 49.6 |
| 2130-1-51-1 | 17.4 | 4.6 | 9.8 | 24.1 | 7.2 | 13.8 | 15.7 | 2.1 | 4.3 | 53.5 | 55.6 |
| 2130-1-51-2 | 18.7 | 3.9 | 9.4 | 20.7 | 6.0 | 14.1 | 18.3 | 2.6 | 5.6 | 60.4 | 58.8 |
| 2130-1-51-3 | 18.4 | 3.8 | 9.3 | 20.4 | 6.6 | 13.4 | 19.0 | 2.3 | 5.9 | 60.0 | 61.3 |
| 2130-1-51-4 | 17.9 | 4.1 | 9.6 | 20.4 | 5.2 | 15.2 | 19.1 | 2.3 | 5.2 | 62.0 | 58.2 |
| 2130-1-51-5 | 21.6 | 6.4 | 12.8 | 20.1 | 7.6 | 11.4 | 12.4 | 2.4 | 4.1 | 52.3 | 54.5 |
| Avg. | 18.8 | 4.6 | 10.2 | 21.1 | 6.5 | 13.6 | 16.9 | 2.3 | 5.0 | 57.6 | 57.7 |
| 2130-1-54-1 | 16.4 | 4.2 | 13.5 | 28.5 | 6.9 | 11.0 | 14.6 | 1.0 | 3.7 | 46.1 | 60.6 |
| 2130-1-54-2 | 18.1 | 4.1 | 10.8 | 26.2 | 6.9 | 12.3 | 15.9 | 1.3 | 3.9 | 50.3 | 59.4 |
| 2130-1-54-3 | 17.5 | 4.1 | 11.9 | 27.2 | 7.3 | 10.2 | 16.6 | 0.8 | 3.7 | 47.6 | 64.9 |
| 2130-1-54-4 | 16.7 | 4.2 | 10.9 | 28.3 | 7.3 | 14.9 | 12.3 | 1.6 | 3.2 | 47.3 | 48.4 |
| 2130-1-54-5 | 17.1 | 4.3 | 12.0 | 27.0 | 7.3 | 10.6 | 15.6 | 1.1 | 4.3 | 47.9 | 62.9 |
| Avg. | 17.2 | 4.2 | 11.8 | 27.5 | 7.1 | 11.8 | 15.0 | 1.2 | 3.8 | 47.9 | 59.2 |
| 2130-1-61-1 | 21.4 | 5.2 | 7.3 | 19.5 | 6.1 | 13.7 | 15.6 | 3.2 | 7.0 | 60.7 | 57.2 |
| 2130-1-61-2 | 17.2 | 3.5 | 5.4 | 20.3 | 7.8 | 14.4 | 18.0 | 4.1 | 8.7 | 61.6 | 58.9 |
| 2130-1-61-3 | 17.3 | 4.4 | 6.9 | 25.0 | 9.4 | 13.1 | 14.1 | 3.1 | 5.7 | 51.1 | 55.0 |
| 2130-1-61-4 | 21.0 | 7.1 | 11.2 | 18.1 | 6.6 | 11.0 | 15.7 | 2.7 | 6.0 | 58.9 | 61.2 |
| 2130-1-61-5 | 20.1 | 4.3 | 6.7 | 19.9 | 5.9 | 14.7 | 17.3 | 3.3 | 6.7 | 61.9 | 57.2 |
| Avg. | 19.4 | 4.9 | 7.5 | 20.6 | 7.2 | 13.4 | 16.1 | 3.3 | 6.8 | 58.8 | 57.9 |

FIG. 68

| Event | Fatty acid composition (wt.%) | | | | | | | | | C18 % delta-9 elong | C20 % delta-8 desat |
|---|---|---|---|---|---|---|---|---|---|---|---|
| | 16:0 | 18:0 | 18:1 | LA | ALA | EDA | DGLA | ERA | ETA | | |
| 2153-1-3-1 | 15.4 | 5.1 | 27.5 | 25.7 | 7.7 | 5.3 | 10.4 | 0.5 | 2.3 | 35.6 | 68.6 |
| 2153-1-3-2 | 17.2 | 3.5 | 15.5 | 36.1 | 18.6 | 3.2 | 4.2 | 0.5 | 1.1 | 14.2 | 58.3 |
| 2153-1-3-3 | 16.4 | 5.1 | 28.3 | 24.2 | 8.6 | 4.8 | 9.6 | 0.6 | 2.4 | 34.6 | 69.3 |
| 2153-1-3-4 | 16.0 | 3.9 | 24.1 | 26.9 | 9.4 | 6.6 | 9.9 | 0.8 | 2.5 | 35.3 | 62.8 |
| 2153-1-3-5 | 15.6 | 3.9 | 25.5 | 26.7 | 7.7 | 6.6 | 11.0 | 0.6 | 2.5 | 37.6 | 65.2 |
| Avg. | 16.1 | 4.3 | 24.2 | 27.9 | 10.4 | 5.3 | 9.0 | 0.6 | 2.2 | 31.5 | 64.8 |
| 2153-1-5-1 | 17.4 | 3.9 | 16.9 | 30.8 | 11.7 | 5.6 | 10.6 | 0.6 | 2.5 | 31.2 | 67.8 |
| 2153-1-5-2 | 16.6 | 4.2 | 19.4 | 29.3 | 10.6 | 6.7 | 10.1 | 0.6 | 2.5 | 33.3 | 63.3 |
| 2153-1-5-3 | 17.2 | 3.4 | 14.9 | 37.2 | 17.4 | 4.1 | 3.9 | 0.6 | 1.3 | 15.3 | 52.8 |
| 2153-1-5-4 | 17.5 | 4.4 | 18.8 | 29.1 | 10.7 | 5.1 | 11.1 | 0.6 | 2.7 | 32.9 | 70.4 |
| 2153-1-5-5 | 16.9 | 4.5 | 18.7 | 28.8 | 10.8 | 5.8 | 11.0 | 0.7 | 2.9 | 34.0 | 68.2 |
| Avg. | 17.1 | 4.1 | 17.7 | 31.0 | 12.3 | 5.5 | 9.3 | 0.6 | 2.4 | 29.3 | 64.5 |
| 2153-1-14-1 | 17.8 | 3.5 | 19.6 | 30.6 | 10.4 | 5.8 | 9.3 | 0.6 | 2.4 | 30.6 | 64.7 |
| 2153-1-14-2 | 18.2 | 3.7 | 17.5 | 32.0 | 13.5 | 5.1 | 7.4 | 0.7 | 2.0 | 25.1 | 62.1 |
| 2153-1-14-3 | 18.6 | 3.1 | 17.7 | 32.2 | 13.1 | 5.3 | 6.8 | 0.7 | 2.4 | 25.2 | 60.8 |
| 2153-1-14-4 | 18.5 | 3.0 | 14.6 | 33.4 | 12.5 | 6.1 | 8.6 | 0.7 | 2.6 | 28.2 | 62.1 |
| 2153-1-14-5 | 18.0 | 3.4 | 19.1 | 30.7 | 11.8 | 4.9 | 8.8 | 0.5 | 2.7 | 28.6 | 68.0 |
| Avg. | 18.2 | 3.3 | 17.7 | 31.8 | 12.3 | 5.4 | 8.2 | 0.6 | 2.4 | 27.5 | 63.6 |
| 2153-1-22-1 | 16.9 | 4.2 | 20.1 | 27.7 | 9.9 | 5.4 | 11.4 | 0.7 | 3.7 | 36.0 | 71.1 |
| 2153-1-22-2 | 17.2 | 3.9 | 18.5 | 32.4 | 13.3 | 4.9 | 6.6 | 0.7 | 2.5 | 24.4 | 61.9 |
| 2153-1-22-3 | 16.3 | 4.6 | 22.5 | 25.1 | 8.4 | 5.4 | 12.8 | 0.7 | 4.1 | 40.7 | 73.3 |
| 2153-1-22-4 | 16.3 | 3.7 | 19.2 | 26.2 | 8.0 | 6.6 | 15.2 | 0.7 | 4.1 | 43.8 | 72.5 |
| 2153-1-22-5 | 16.6 | 3.6 | 16.1 | 39.2 | 15.8 | 2.8 | 4.0 | 0.5 | 1.5 | 13.6 | 62.5 |
| Avg. | 16.7 | 4.0 | 19.3 | 30.1 | 11.1 | 5.0 | 10.0 | 0.7 | 3.2 | 31.7 | 68.2 |
| 2153-3-4-1 | 16.5 | 2.8 | 14.5 | 34.6 | 13.9 | 6.6 | 7.5 | 1.1 | 2.5 | 26.8 | 56.5 |
| 2153-3-4-2 | 16.4 | 3.1 | 16.0 | 30.9 | 10.9 | 8.0 | 10.5 | 1.2 | 3.1 | 35.3 | 59.8 |
| 2153-3-4-3 | 15.6 | 4.2 | 19.5 | 29.5 | 11.0 | 6.9 | 9.3 | 1.1 | 3.0 | 33.4 | 60.3 |
| 2153-3-4-4 | 15.7 | 3.2 | 17.4 | 31.2 | 11.5 | 7.6 | 9.2 | 1.2 | 3.0 | 32.9 | 57.8 |
| 2153-3-4-5 | 15.7 | 2.6 | 14.4 | 34.8 | 13.5 | 6.8 | 8.3 | 1.1 | 2.8 | 28.2 | 58.3 |
| Avg. | 16.0 | 3.2 | 16.3 | 32.2 | 12.2 | 7.2 | 8.9 | 1.1 | 2.9 | 31.3 | 58.5 |

FIG. 69

| Event | Fatty acid composition (wt.%) | | | | | | | | | C18 % delta-9 elong | C20 % delta-8 desat |
|---|---|---|---|---|---|---|---|---|---|---|---|
| | 16:0 | 18:0 | 18:1 | LA | ALA | EDA | DGLA | ERA | ETA | | |
| 2154-1-3-1 | 18.3 | 4.9 | 29.7 | 23.8 | 8.4 | 4.5 | 7.2 | 0.5 | 2.6 | 31.5 | 66.4 |
| 2154-1-3-2 | 19.1 | 4.5 | 28.5 | 24.0 | 7.5 | 5.5 | 7.8 | 0.5 | 2.5 | 34.1 | 63.2 |
| 2154-1-3-3 | 18.8 | 4.4 | 20.9 | 32.2 | 9.3 | 6.7 | 5.6 | 0.6 | 1.7 | 26.0 | 50.0 |
| 2154-1-3-4 | 17.2 | 4.0 | 21.6 | 29.3 | 9.1 | 7.7 | 8.1 | 0.6 | 2.3 | 32.9 | 55.7 |
| 2154-1-3-5 | 16.8 | 3.9 | 29.1 | 24.8 | 9.4 | 5.6 | 6.9 | 0.7 | 2.8 | 31.9 | 60.5 |
| Avg. | 18.0 | 4.4 | 26.0 | 26.8 | 8.7 | 6.0 | 7.1 | 0.6 | 2.4 | 31.3 | 59.2 |
| 2154-1-8-1 | 17.6 | 3.5 | 18.7 | 29.9 | 12.3 | 6.2 | 8.4 | 0.7 | 2.8 | 30.0 | 62.0 |
| 2154-1-8-2 | 17.9 | 4.4 | 21.6 | 30.3 | 10.6 | 5.8 | 6.6 | 0.8 | 2.1 | 27.1 | 57.1 |
| 2154-1-8-3 | 18.2 | 3.4 | 18.2 | 30.8 | 11.4 | 7.3 | 7.3 | 0.8 | 2.6 | 30.0 | 54.8 |
| 2154-1-8-4 | 17.4 | 3.7 | 20.3 | 33.0 | 11.1 | 5.9 | 6.1 | 0.6 | 1.9 | 24.7 | 54.9 |
| 2154-1-8-5 | 17.7 | 3.6 | 21.2 | 27.7 | 11.0 | 7.2 | 8.0 | 0.8 | 2.9 | 32.8 | 57.9 |
| Avg. | 17.8 | 3.7 | 20.0 | 30.3 | 11.3 | 6.5 | 7.3 | 0.7 | 2.5 | 28.9 | 57.4 |
| 2154-1-12-1 | 18.5 | 4.5 | 22.1 | 28.4 | 10.7 | 5.7 | 7.1 | 0.6 | 2.5 | 28.8 | 60.5 |
| 2154-1-12-2 | 18.1 | 3.4 | 16.8 | 31.0 | 14.2 | 6.1 | 6.7 | 0.9 | 2.8 | 26.7 | 57.7 |
| 2154-1-12-3 | 17.7 | 3.6 | 16.5 | 31.7 | 14.2 | 6.4 | 6.8 | 0.7 | 2.4 | 26.3 | 56.2 |
| 2154-1-12-4 | 18.0 | 3.6 | 16.7 | 32.3 | 14.0 | 6.3 | 5.9 | 0.9 | 2.4 | 25.2 | 53.6 |
| 2154-1-12-5 | 18.2 | 3.9 | 18.9 | 30.1 | 12.0 | 5.9 | 7.3 | 0.8 | 2.8 | 28.5 | 60.0 |
| Avg. | 18.1 | 3.8 | 18.2 | 30.7 | 13.0 | 6.1 | 6.7 | 0.8 | 2.6 | 27.1 | 57.6 |
| 2154-1-15-1 | 18.3 | 3.1 | 23.9 | 23.4 | 10.5 | 5.8 | 9.8 | 0.8 | 4.4 | 38.0 | 68.1 |
| 2154-1-15-2 | 20.0 | 4.4 | 10.8 | 40.8 | 23.5 | 0.3 | 0.1 | 0.0 | 0.0 | 0.7 | 31.6 |
| 2154-1-15-3 | 18.2 | 3.2 | 17.9 | 29.0 | 12.3 | 6.2 | 8.6 | 0.8 | 3.9 | 32.1 | 64.2 |
| 2154-1-15-4 | 18.5 | 3.9 | 18.9 | 28.5 | 15.1 | 5.1 | 6.4 | 0.7 | 2.9 | 25.8 | 61.5 |
| 2154-1-15-5 | 18.7 | 3.4 | 17.0 | 28.9 | 13.7 | 5.6 | 8.1 | 0.9 | 3.6 | 29.9 | 64.3 |
| Avg. | 18.7 | 3.6 | 17.7 | 30.1 | 15.0 | 4.6 | 6.6 | 0.6 | 3.0 | 25.3 | 57.9 |
| 2154-2-13-1 | 16.2 | 3.6 | 21.8 | 27.7 | 16.5 | 3.4 | 6.5 | 0.8 | 3.5 | 24.3 | 70.4 |
| 2154-2-13-2 | 17.3 | 3.9 | 21.4 | 29.6 | 13.8 | 4.2 | 6.6 | 0.6 | 2.6 | 24.5 | 65.6 |
| 2154-2-13-3 | 16.6 | 3.8 | 17.8 | 32.9 | 15.6 | 3.8 | 6.3 | 0.5 | 2.7 | 21.5 | 67.4 |
| 2154-2-13-4 | 16.4 | 5.5 | 28.0 | 25.3 | 10.3 | 4.4 | 6.5 | 0.7 | 3.0 | 29.1 | 65.0 |
| 2154-2-13-5 | 17.2 | 4.7 | 25.1 | 26.2 | 13.3 | 3.0 | 6.7 | 0.5 | 3.3 | 25.4 | 74.2 |
| Avg. | 16.8 | 4.3 | 22.8 | 28.3 | 13.9 | 3.7 | 6.5 | 0.6 | 3.0 | 25.0 | 68.5 |

FIG. 70

| Event | Fatty acid composition (wt.%) | | | | | | | | | C18 % delta-9 elong | C20 % delta-8 desat |
| --- | --- | --- | --- | --- | --- | --- | --- | --- | --- | --- | --- |
| | 16:0 | 18:0 | 18:1 | LA | ALA | EDA | DGLA | ERA | ETA | | |
| 2146-2-13-1 | 19.7 | 3.8 | 11.6 | 24.2 | 11.6 | 7.9 | 13.5 | 1.2 | 6.5 | 44.8 | 68.6 |
| 2146-2-13-2 | 20.8 | 3.7 | 11.7 | 21.2 | 9.4 | 7.4 | 17.9 | 0.9 | 7.0 | 52.1 | 75.1 |
| 2146-2-13-3 | 20.1 | 3.0 | 7.0 | 24.3 | 11.6 | 7.6 | 17.3 | 1.1 | 8.1 | 48.8 | 74.6 |
| 2146-2-13-4 | 20.8 | 3.7 | 10.2 | 22.3 | 10.3 | 7.4 | 16.5 | 1.0 | 7.7 | 50.0 | 74.1 |
| 2146-2-13-5 | 18.9 | 3.3 | 9.5 | 25.0 | 14.2 | 6.4 | 14.2 | 1.2 | 7.4 | 42.7 | 74.0 |
| Avg. | 20.1 | 3.5 | 10.0 | 23.4 | 11.4 | 7.3 | 15.9 | 1.1 | 7.4 | 47.7 | 73.3 |
| 2146-3-2-1 | 16.8 | 3.2 | 10.8 | 26.3 | 12.2 | 6.2 | 12.1 | 1.0 | 5.6 | 39.3 | 71.1 |
| 2146-3-2-2 | 19.1 | 4.4 | 13.6 | 26.8 | 14.9 | 4.8 | 10.1 | 1.0 | 5.3 | 33.6 | 72.8 |
| 2146-3-2-3 | 18.4 | 4.0 | 14.7 | 24.7 | 12.2 | 5.7 | 12.7 | 1.0 | 6.5 | 41.3 | 74.1 |
| 2146-3-2-4 | 18.4 | 3.6 | 12.5 | 27.9 | 15.1 | 5.1 | 10.6 | 1.0 | 5.9 | 34.5 | 72.9 |
| 2146-3-2-5 | 19.7 | 4.0 | 13.5 | 28.0 | 13.5 | 5.4 | 10.1 | 0.9 | 4.8 | 33.9 | 70.1 |
| Avg. | 18.5 | 3.8 | 13.0 | 26.7 | 13.6 | 5.4 | 11.1 | 1.0 | 5.6 | 36.5 | 72.2 |
| 2146-3-9-1 | 19.0 | 3.1 | 10.3 | 26.3 | 10.7 | 7.4 | 14.8 | 1.2 | 7.2 | 45.2 | 72.0 |
| 2146-3-9-2 | 16.9 | 3.8 | 12.5 | 26.4 | 12.0 | 6.9 | 13.1 | 1.3 | 7.1 | 42.6 | 71.3 |
| 2146-3-9-3 | 19.5 | 3.7 | 11.5 | 26.5 | 11.3 | 6.1 | 13.7 | 1.0 | 6.7 | 42.1 | 74.0 |
| 2146-3-9-4 | 17.9 | 3.9 | 13.1 | 26.4 | 13.5 | 6.7 | 10.9 | 1.4 | 6.2 | 38.7 | 67.8 |
| 2146-3-9-5 | 17.9 | 4.2 | 15.0 | 25.6 | 11.2 | 6.1 | 12.4 | 1.1 | 6.6 | 41.6 | 72.7 |
| Avg. | 18.2 | 3.8 | 12.5 | 26.2 | 11.7 | 6.6 | 13.0 | 1.2 | 6.7 | 42.0 | 71.6 |
| 2146-3-13-1 | 16.1 | 3.9 | 16.5 | 29.2 | 7.9 | 9.9 | 11.0 | 1.0 | 4.5 | 41.6 | 58.7 |
| 2146-3-13-2 | 16.7 | 3.4 | 15.2 | 29.9 | 10.6 | 7.2 | 11.3 | 1.1 | 4.6 | 37.3 | 65.8 |
| 2146-3-13-3 | 16.0 | 4.4 | 16.5 | 29.2 | 9.2 | 7.9 | 11.1 | 1.0 | 4.8 | 39.2 | 64.1 |
| 2146-3-13-4 | 17.5 | 3.4 | 11.8 | 31.4 | 13.9 | 6.8 | 9.7 | 1.1 | 4.3 | 32.5 | 64.1 |
| 2146-3-13-5 | 16.5 | 3.4 | 15.0 | 30.3 | 10.2 | 7.9 | 11.1 | 1.2 | 4.5 | 37.8 | 63.3 |
| Avg. | 16.6 | 3.7 | 15.0 | 30.0 | 10.3 | 7.9 | 10.8 | 1.1 | 4.5 | 37.7 | 63.2 |
| 2146-3-19-1 | 16.4 | 3.6 | 13.6 | 32.0 | 12.5 | 7.6 | 9.3 | 1.1 | 4.0 | 33.1 | 60.5 |
| 2146-3-19-2 | 18.8 | 3.8 | 10.4 | 30.3 | 15.2 | 5.4 | 10.2 | 1.1 | 4.8 | 32.1 | 69.9 |
| 2146-3-19-3 | 16.9 | 2.9 | 9.7 | 30.4 | 10.3 | 8.2 | 14.8 | 1.1 | 5.7 | 42.3 | 68.6 |
| 2146-3-19-4 | 17.2 | 3.1 | 9.3 | 27.4 | 11.7 | 8.0 | 15.6 | 1.3 | 6.5 | 44.6 | 70.6 |
| 2146-3-19-5 | 16.7 | 3.3 | 9.9 | 32.9 | 11.3 | 9.0 | 11.4 | 1.2 | 4.4 | 37.0 | 60.8 |
| Avg. | 17.2 | 3.3 | 10.6 | 30.6 | 12.2 | 7.6 | 12.3 | 1.2 | 5.1 | 37.8 | 66.1 |

| | 16:0 | 18:0 | 18:1 | 18:2 (5,9) | LA | ALA | EDA | SCI | DGLA | ARA | ERA | JUN | ETA | EPA | Other | %Elo | %D8 | %D5 |
|---|---|---|---|---|---|---|---|---|---|---|---|---|---|---|---|---|---|---|
| 2274-1-4-1 | 15.0 | 3.8 | 13.0 | 0.0 | 33.4 | 8.5 | 8.4 | 0.7 | 1.8 | 9.7 | 1.1 | 0.0 | 0.3 | 3.2 | 1.3 | 36.9 | 61.0 | 86.2 |
| 2274-1-4-2 | 14.3 | 3.6 | 14.6 | 0.2 | 31.3 | 7.2 | 9.4 | 0.7 | 2.4 | 10.3 | 1.0 | 0.2 | 0.3 | 3.1 | 1.3 | 40.8 | 60.5 | 83.2 |
| 2274-1-4-3 | 14.2 | 4.4 | 15.3 | 0.0 | 32.7 | 7.4 | 8.8 | 0.7 | 2.1 | 9.2 | 0.9 | 0.1 | 0.2 | 2.8 | 1.3 | 37.5 | 59.6 | 83.9 |
| 2274-1-4-4 | 16.0 | 3.1 | 16.7 | 0.0 | 32.0 | 7.8 | 8.9 | 0.7 | 1.6 | 8.1 | 1.0 | 0.2 | 0.2 | 2.7 | 1.1 | 36.1 | 56.0 | 85.6 |
| 2274-1-4-5 | 15.2 | 4.5 | 16.6 | 1.8 | 30.6 | 7.0 | 9.2 | 0.7 | 1.6 | 7.9 | 1.0 | 0.1 | 0.2 | 2.4 | 1.1 | 37.1 | 54.6 | 85.0 |
| Avg. | 14.9 | 3.9 | 15.2 | 0.4 | 32.0 | 7.6 | 8.9 | 0.7 | 1.9 | 9.0 | 1.0 | 0.1 | 0.2 | 2.9 | 1.2 | 37.7 | 58.3 | 84.8 |
| 2274-2-2-1 | 14.1 | 4.4 | 11.8 | 0.0 | 30.0 | 9.1 | 9.4 | 0.9 | 1.9 | 11.4 | 1.3 | 0.2 | 0.3 | 4.0 | 1.2 | 41.9 | 62.4 | 87.5 |
| 2274-2-2-2 | 16.2 | 4.1 | 14.6 | 0.0 | 28.3 | 10.5 | 6.6 | 0.7 | 1.6 | 10.1 | 1.1 | 0.2 | 0.2 | 4.3 | 1.5 | 38.1 | 67.7 | 88.6 |
| 2274-2-2-3 | 16.5 | 5.0 | 11.2 | 0.0 | 28.6 | 11.0 | 6.8 | 0.7 | 1.8 | 11.0 | 1.1 | 0.2 | 0.3 | 4.3 | 1.6 | 38.8 | 68.9 | 88.4 |
| 2274-2-2-4 | 14.6 | 4.1 | 14.8 | 0.0 | 30.1 | 8.4 | 7.8 | 0.0 | 3.0 | 10.5 | 1.0 | 0.0 | 0.4 | 3.9 | 1.5 | 40.8 | 66.9 | 80.9 |
| 2274-2-2-5 | 15.5 | 5.0 | 15.3 | 0.0 | 28.9 | 10.0 | 6.4 | 0.4 | 2.3 | 9.6 | 0.8 | 0.1 | 0.2 | 4.0 | 1.5 | 37.5 | 69.2 | 84.5 |
| Avg. | 15.4 | 4.5 | 13.5 | 0.0 | 29.2 | 9.8 | 7.4 | 0.5 | 2.1 | 10.5 | 1.1 | 0.1 | 0.3 | 4.1 | 1.5 | 39.4 | 67.0 | 86.0 |
| 2274-3-1-1 | 16.4 | 4.5 | 14.8 | 0.0 | 28.7 | 10.6 | 7.7 | 0.6 | 1.5 | 8.6 | 1.3 | 0.2 | 0.3 | 3.7 | 1.2 | 37.0 | 61.0 | 87.6 |
| 2274-3-1-2 | 16.1 | 5.4 | 14.0 | 0.0 | 31.7 | 10.9 | 7.4 | 0.4 | 1.3 | 7.9 | 1.0 | 0.0 | 0.2 | 2.8 | 1.0 | 32.6 | 59.2 | 87.6 |
| 2274-3-1-3 | 16.1 | 4.0 | 12.7 | 0.0 | 33.3 | 11.5 | 7.8 | 0.4 | 1.3 | 7.7 | 1.1 | 0.0 | 0.2 | 3.1 | 1.0 | 32.0 | 57.9 | 88.1 |
| 2274-3-1-4 | 16.1 | 4.2 | 10.1 | 0.0 | 28.4 | 9.0 | 8.9 | 0.9 | 2.0 | 12.6 | 1.2 | 0.3 | 0.3 | 4.7 | 1.4 | 44.3 | 66.2 | 88.3 |
| 2274-3-1-5 | 16.1 | 4.5 | 10.7 | 0.0 | 36.8 | 13.8 | 5.7 | 0.5 | 0.6 | 5.9 | 1.1 | 0.0 | 0.4 | 3.1 | 0.7 | 25.0 | 59.3 | 89.8 |
| Avg. | 16.2 | 4.5 | 12.4 | 0.0 | 31.8 | 11.1 | 7.5 | 0.6 | 1.3 | 8.5 | 1.1 | 0.1 | 0.3 | 3.5 | 1.1 | 34.2 | 60.7 | 88.3 |
| 2274-3-3-1 | 15.1 | 3.4 | 15.9 | 0.0 | 30.5 | 9.5 | 6.3 | 0.5 | 2.5 | 9.1 | 1.0 | 0.2 | 0.3 | 4.0 | 1.8 | 36.7 | 68.7 | 82.3 |
| 2274-3-3-2 | 14.9 | 4.4 | 16.4 | 1.7 | 28.9 | 8.3 | 7.1 | 0.5 | 2.7 | 8.9 | 0.9 | 0.1 | 0.3 | 3.3 | 1.6 | 38.5 | 65.4 | 80.3 |
| 2274-3-3-3 | 14.7 | 2.9 | 13.3 | 0.2 | 30.9 | 9.8 | 7.1 | 0.5 | 2.7 | 10.6 | 1.0 | 0.1 | 0.3 | 3.9 | 1.7 | 38.8 | 68.4 | 82.7 |
| 2274-3-3-4 | 14.0 | 4.8 | 17.0 | 1.8 | 28.1 | 6.8 | 8.2 | 0.6 | 2.6 | 9.8 | 0.8 | 0.1 | 0.3 | 3.4 | 1.6 | 41.9 | 64.2 | 82.0 |
| 2274-3-3-5 | 14.1 | 3.6 | 16.2 | 0.3 | 29.4 | 8.4 | 7.3 | 0.0 | 3.8 | 10.0 | 0.9 | 0.1 | 0.3 | 3.6 | 1.8 | 40.8 | 68.4 | 76.6 |
| Avg. | 14.5 | 3.8 | 15.8 | 0.8 | 29.6 | 8.6 | 7.2 | 0.4 | 2.9 | 9.7 | 0.9 | 0.1 | 0.3 | 3.7 | 1.7 | 39.3 | 67.0 | 80.8 |
| 2274-5-4-1 | 15.3 | 4.6 | 14.9 | 0.0 | 30.4 | 12.1 | 6.0 | 0.0 | 2.4 | 7.4 | 0.9 | 0.0 | 0.3 | 3.4 | 2.2 | 32.5 | 66.2 | 80.1 |
| 2274-5-4-2 | 17.3 | 3.7 | 10.1 | 0.0 | 40.0 | 18.2 | 4.1 | 0.2 | 0.4 | 2.5 | 0.9 | 0.0 | 0.1 | 1.7 | 1.0 | 14.2 | 48.2 | 89.3 |
| 2274-5-4-3 | 15.9 | 5.4 | 14.7 | 0.0 | 28.8 | 10.1 | 6.0 | 0.0 | 3.2 | 9.2 | 0.7 | 0.0 | 0.3 | 3.8 | 2.0 | 37.4 | 71.0 | 78.8 |
| 2274-5-4-4 | 15.2 | 4.4 | 18.1 | 0.3 | 27.4 | 9.0 | 5.5 | 0.0 | 3.7 | 9.4 | 0.8 | 0.0 | 0.5 | 3.8 | 1.9 | 39.5 | 73.5 | 75.9 |
| 2274-5-4-5 | 15.3 | 5.4 | 14.3 | 0.0 | 31.5 | 12.1 | 5.3 | 0.0 | 2.5 | 7.3 | 0.7 | 0.0 | 0.3 | 3.2 | 2.1 | 30.6 | 68.9 | 79.2 |
| Avg. | 15.8 | 4.7 | 14.4 | 0.1 | 31.6 | 12.3 | 5.4 | 0.0 | 2.4 | 7.2 | 0.8 | 0.0 | 0.3 | 3.2 | 1.8 | 30.8 | 65.6 | 80.7 |

| Event | Fatty acid composition (wt.%) | | | | | | | | | C18 % delta-9 elong | C20 % delta-8 desat |
|---|---|---|---|---|---|---|---|---|---|---|---|
| | 16:0 | 18:0 | 18:1 | LA | ALA | EDA | DGLA | ERA | ETA | | |
| 2275-1-1-1 | 13.5 | 2.3 | 13.8 | 33.8 | 9.8 | 6.9 | 15.0 | 0.9 | 4.0 | 38.0 | 70.7 |
| 2275-1-1-2 | 13.5 | 2.6 | 13.9 | 32.3 | 8.1 | 6.8 | 17.1 | 1.0 | 4.7 | 42.2 | 73.6 |
| 2275-1-1-3 | 15.1 | 3.2 | 11.5 | 35.8 | 11.5 | 5.9 | 12.5 | 0.9 | 3.5 | 32.5 | 70.2 |
| 2275-1-1-4 | 15.8 | 3.3 | 11.8 | 32.9 | 10.4 | 6.7 | 14.1 | 1.0 | 4.0 | 37.3 | 70.1 |
| 2275-1-1-5 | 13.7 | 2.5 | 16.9 | 36.2 | 11.6 | 4.8 | 10.4 | 0.8 | 3.2 | 28.6 | 70.7 |
| Avg. | 14.3 | 2.8 | 13.6 | 34.2 | 10.3 | 6.2 | 13.8 | 0.9 | 3.9 | 35.7 | 71.1 |
| 2275-1-2-1 | 13.8 | 2.8 | 16.5 | 30.6 | 7.6 | 8.6 | 14.5 | 1.2 | 4.4 | 42.9 | 66.1 |
| 2275-1-2-2 | 13.4 | 2.4 | 12.8 | 31.9 | 8.6 | 9.9 | 15.2 | 1.3 | 4.5 | 43.3 | 63.7 |
| 2275-1-2-3 | 13.9 | 2.9 | 13.4 | 33.0 | 9.3 | 9.7 | 12.6 | 1.3 | 3.9 | 39.3 | 60.2 |
| 2275-1-2-4 | 14.6 | 3.2 | 10.9 | 31.8 | 10.1 | 9.1 | 14.5 | 1.3 | 4.4 | 41.3 | 64.4 |
| 2275-1-2-5 | 13.2 | 2.6 | 11.5 | 32.4 | 10.2 | 9.0 | 15.0 | 1.4 | 4.7 | 41.3 | 65.5 |
| Avg. | 13.8 | 2.8 | 13.0 | 31.9 | 9.2 | 9.3 | 14.4 | 1.3 | 4.4 | 41.6 | 64.0 |
| 2275-3-4-1 | 16.5 | 3.3 | 16.7 | 32.0 | 9.7 | 6.0 | 12.0 | 0.9 | 3.0 | 34.4 | 68.6 |
| 2275-3-4-2 | 17.3 | 3.7 | 14.8 | 34.9 | 11.5 | 6.5 | 8.0 | 1.0 | 2.3 | 27.8 | 57.6 |
| 2275-3-4-3 | 17.7 | 3.6 | 15.2 | 33.9 | 10.6 | 6.8 | 8.8 | 1.1 | 2.3 | 30.0 | 58.2 |
| 2275-3-4-4 | 15.7 | 4.0 | 13.8 | 32.3 | 9.8 | 8.3 | 12.0 | 1.1 | 2.9 | 36.6 | 61.0 |
| 2275-3-4-5 | 17.8 | 3.1 | 10.5 | 34.5 | 10.8 | 8.0 | 11.3 | 1.2 | 2.8 | 34.0 | 60.7 |
| Avg. | 17.0 | 3.5 | 14.2 | 33.5 | 10.5 | 7.1 | 10.4 | 1.1 | 2.7 | 32.5 | 61.2 |
| 2275-3-8-1 | 16.3 | 3.9 | 12.5 | 32.9 | 10.4 | 5.8 | 13.7 | 1.3 | 3.3 | 35.8 | 70.8 |
| 2275-3-8-2 | 16.6 | 5.1 | 14.3 | 30.4 | 8.7 | 7.7 | 12.7 | 1.3 | 3.1 | 38.8 | 63.8 |
| 2275-3-8-3 | 16.0 | 5.0 | 14.8 | 30.8 | 8.5 | 6.8 | 13.8 | 1.1 | 3.2 | 38.7 | 68.5 |
| 2275-3-8-4 | 16.6 | 4.5 | 12.9 | 30.3 | 8.4 | 7.4 | 15.4 | 1.1 | 3.6 | 41.5 | 69.3 |
| 2275-3-8-5 | 17.6 | 4.0 | 12.0 | 32.3 | 10.6 | 5.6 | 13.1 | 1.0 | 3.7 | 35.4 | 71.8 |
| Avg. | 16.6 | 4.5 | 13.3 | 31.3 | 9.3 | 6.6 | 13.8 | 1.1 | 3.4 | 38.1 | 68.8 |
| 2275-6-1-1 | 16.0 | 4.4 | 19.0 | 28.6 | 8.5 | 6.5 | 12.2 | 1.3 | 3.6 | 38.8 | 66.9 |
| 2275-6-1-2 | 15.2 | 4.2 | 19.4 | 29.2 | 9.0 | 6.4 | 12.1 | 1.3 | 3.2 | 37.6 | 66.6 |
| 2275-6-1-3 | 16.1 | 3.3 | 15.4 | 29.6 | 9.6 | 6.7 | 14.2 | 1.1 | 4.1 | 39.9 | 70.1 |
| 2275-6-1-4 | 15.8 | 3.8 | 19.8 | 29.5 | 8.0 | 6.8 | 11.8 | 1.4 | 3.1 | 38.1 | 64.7 |
| 2275-6-1-5 | 15.2 | 3.8 | 20.3 | 27.6 | 7.6 | 6.8 | 13.4 | 1.5 | 3.8 | 42.0 | 67.6 |
| Avg. | 15.7 | 3.9 | 18.8 | 28.9 | 8.5 | 6.6 | 12.7 | 1.3 | 3.6 | 39.3 | 67.2 |

MULTIZYMES COMPRISING DELTA-9 ELONGASE AND DELTA-8 DESATURASE AND THEIR USE IN MAKING POLYUNSATURATED FATTY ACIDS

This application claims the benefit of U.S. Provisional Application No. 60/909,790, filed Apr. 3, 2007, and U.S. Provisional Application No. 61/027,898, filed Feb. 12, 2008, the disclosures of which are hereby incorporated in their entirety.

FIELD OF THE INVENTION

This invention is in the field of biotechnology. More specifically, this invention pertains to polynucleotide sequences encoding multizymes and their use in the synthesis of long-chain polyunsaturated fatty acids (PUFAs).

BACKGROUND OF THE INVENTION

The importance of PUFAs is undisputed. For example, certain PUFAs are important biological components of healthy cells and are recognized as: "essential" fatty acids that cannot be synthesized de novo in mammals and instead must be obtained either in the diet or derived by further elongation and desaturation of linoleic acid (LA; 18:2 omega-6) or α-linolenic acid (ALA; 18:3 omega-3); constituents of plasma membranes of cells, where they may be found in such forms as phospholipids or triacylglycerols; necessary for proper development (particularly in the developing infant brain) and for tissue formation and repair; and, precursors to several biologically active eicosanoids of importance in mammals (e.g., prostacyclins, eicosanoids, leukotrienes, prostaglandins). Additionally, a high intake of long-chain omega-3 PUFAs produces cardiovascular protective effects (Dyerberg et al., *Amer. J. Clin. Nutr.* 28:958-966 (1975); Dyerberg et al., *Lancet* 2(8081):117-119 (1978); Shimokawa, H., *World Rev. Nutr. Diet* 88:100-108 (2001); von Schacky et al., *World Rev. Nutr. Diet* 88:90-99 (2001)). Numerous other studies document wide-ranging health benefits conferred by administration of omega-3 and/or omega-6 PUFAs against a variety of symptoms and diseases (e.g., asthma, psoriasis, eczema, diabetes, cancer).

Today, a variety of different hosts including plants, algae, fungi, and yeast are being investigated as means for commercial PUFA production via numerous divergent efforts. Although the natural PUFA-producing abilities of the host organisms are sometimes essential to a given methodology, genetic engineering has also proven that the natural abilities of some hosts (even those natively limited to LA and ALA fatty acid production) can be substantially altered to result in high-level production of various long-chain omega-3/omega-6 PUFAs. Whether this effect is the result of natural abilities or recombinant technology, arachidonic acid (ARA; 20:4 omega-6), eicosapentaenoic acid (EPA; 20:5 omega-3), and docosahexaenoic acid (DHA; 22:6 omega-3) all require expression of either the delta-9 elongase/delta-8 desaturase pathway (which operates in some organisms, such as euglenoid species and which is characterized by the production of eicosadienoic acid (EDA; 20:2 omega-6) and/or eicosatrienoic acid (ETrA; 20:3 omega-3)) or the delta-6 desaturase/delta-6 elongase pathway (which is predominantly found in algae, mosses, fungi, nematodes and humans and which is characterized by the production of gamma-linolenic acid (GLA; 18:3 omega-6) and/or stearidonic acid (STA; 18:4 omega-3)) (FIG. 1). A delta-6 elongase is also known as a $C_{18/20}$ elongase.

The delta-8 desaturase enzymes identified thus far have the ability to convert both EDA to dihomo gamma-linolenic acid (DGLA (also known as HGLA); 20:3, n-6) and ETrA to eicosatetraenoic acid (ETA; 20:4, n-3). ARA and EPA are subsequently synthesized from DGLA and ETA, respectively, following reaction with a delta-5 desaturase. DHA synthesis, however, requires the subsequent expression of an additional $C_{20/22}$ elongase and a delta-4 desaturase. Most $C_{20/22}$ elongases identified so far have the primary ability to convert EPA to DPA, with secondary activity in converting arachidonic acid (ARA; 20:4 omega-6) to docosatetraenoic acid (DTA; 22:4 omega-6), while most delta-4 desaturase enzymes identified so far have the primary ability to convert DPA to DHA, with secondary activity in converting docosatetraenoic acid (DTA; 22:4 omega-6) to ω-6 docosapentaenoic acid (DPAn-6; 22:5 omega-6).

Based on the role $C_{20/22}$ elongase and delta-4 desaturase enzymes play in the synthesis of DHA, there has been considerable effort to identify and characterize these enzymes from various sources. As such, numerous $C_{20/22}$ elongases have been disclosed in both the open literature and the patent literature (e.g., *Pavlova* sp. CCMP459 (GenBank Accession No. AAV33630), *Ostreococcus tauri* (GenBank Accession No. AAV67798) and *Thalassiosira pseudonana* (GenBank Accession No. AAV67800)). Similarly, the following delta-4 desaturases have been disclosed: *Euglena gracilis* (SEQ ID NO:13; GenBank Accession No. AAQ19605; Meyer et al., *Biochemistry*, 42(32):9779-9788 (2003)); *Thalassiosira pseudonana* (SEQ ID NO:29; GenBank Accession No. AAX14506; Tonon et al., *FEBS J.*, 272(13):3401-3412 (2005)); *Thraustochytrium aureum* (SEQ ID NO:27; GenBank Accession No. AAN75707); *Thraustochytrium* sp. (GenBank Accession No. CAD42496; U.S. Pat. No. 7,087,432); *Schizochytrium aggregatum* (SEQ ID NO:28; PCT Publication No. WO 2002/090493); *Pavlova lutheri* (GenBank Accession No. AAQ98793); and *Isochrysis galbana* (SEQ ID NO:30; GenBank Accession No. AAV33631; Pereira et al., *Biochem. J.*, 384(2):357-366 (2004); PCT Publication No. WO 2002/090493)].

Applicants' Assignee has a number of patent applications concerning the production of PUFAs in oleaginous yeasts (i.e., *Yarrowia lipolytica*), including, for example: U.S. Pat. No. 7,238,482 and No. 7,125,672; U.S. application Ser. No. 11/265,761 (filed Nov. 2, 2005); U.S. application Ser. No. 11/264,784 (filed Nov. 1, 2005); U.S. application Ser. No. 11/264,737 (filed Nov. 1, 2005).

Relatedly, PCT Publication No. WO 2004/071467 (published Aug. 26, 2004) concerns the production of PUFAs in plants, while PCT Publication No. WO 2004/071178 (published Aug. 26, 2004) concerns annexin promoters and their use in expression of transgenes in plants. Both are Applicants' Assignee's copending applications.

SUMMARY OF THE INVENTION

The present invention concerns a multizyme comprising a single polypeptide having at least two independent and separable enzymatic activities.

In a second embodiment the enzymatic activities of the multizyme can be selected from the group consisting of fatty acid elongases, fatty acid desaturases, acyl transferases, acyl CoA synthases, and thioesterases. More specifically, the enzymatic activities can comprise at least one fatty acid elongase linked to at least one fatty acid desaturase.

In a third embodiment the multizyme can comprise a first enzymatic activity linked to a second enzymatic activity and said link is selected from the group consisting of a polypeptide bond, SEQ ID NO:198 (EgDHAsyn1 linker), SEQ ID NO:200 (EgDHAsyn2 linker), SEQ ID NO:235 (EaDHAsyn1 linker), SEQ ID NO:438, SEQ ID NO:445, SEQ ID NO:472, and SEQ ID NO:504.

In a fourth embodiment, the invention concerns an isolated polynucleotide encoding a DHA synthase comprising:
  (a) a nucleotide sequence encoding a polypeptide having DHA synthase activity, wherein the polypeptide has at least 80% amino acid identity, based on the Clustal V method of alignment, when compared to an amino acid sequence as set forth in SEQ ID NO:12, SEQ ID NO:22, SEQ ID NO:95, SEQ ID NO:96, or SEQ ID NO:97;
  (b) a nucleotide sequence encoding a polypeptide having DHA synthase activity wherein the nucleotide sequence has at least 80% sequence identity, based on the BLASTN method of alignment, when compared to a nucleotide sequence as set forth in SEQ ID NO:11, SEQ ID NO:205, SEQ ID NO:21, SEQ ID NO:91, SEQ ID NO:92, SEQ ID NO:93, or SEQ ID NO:410;
  (c) a nucleotide sequence encoding a polypeptide having DHA synthase activity, wherein the nucleotide sequence hybridizes under stringent conditions to a nucleotide sequence as set forth in SEQ ID NO:11, SEQ ID NO:205, SEQ ID NO:21, SEQ ID NO:91, SEQ ID NO:92, SEQ ID NO:93, or SEQ ID NO:410; or
  (d) a complement of the nucleotide sequence of (a), (b) or (c), wherein the complement and the nucleotide sequence consist of the same number of nucleotides and are 100% complementary.

In a fifth embodiment, the invention concerns the polynucleotide encoding a polypeptide having DHA synthase activity wherein the nucleotide sequence comprises SEQ ID NO:11, SEQ ID NO:21, SEQ ID NO:91, SEQ ID NO:92, SEQ ID NO:93, or SEQ ID NO:410.

In a sixth embodiment, the invention concerns the polypeptide of the invention having DHA synthase activity, wherein the amino acid sequence of the polypeptide comprises SEQ ID NO:12, SEQ ID NO:22, SEQ ID NO:95, SEQ ID NO:96, or SEQ ID NO:97.

In a seventh embodiment, the invention concerns an isolated polynucleotide encoding a C20 elongase comprising:
  (a) a nucleotide sequence encoding a polypeptide having C20 elongase activity, wherein the polypeptide has at least 80% amino acid identity, based on the Clustal V method of alignment, when compared to an amino acid sequence as set forth in SEQ ID NO:12, SEQ ID NO:22, SEQ ID NO:95, SEQ ID NO:96, SEQ ID NO:97, SEQ ID NO:202 (EgDHAsyn1 C20 elongase domain), SEQ ID NO:204 (EgDHAsyn2 C20 elongase domain), SEQ ID NO:231 (EaDHAsyn1 C20 elongase domain), SEQ ID NO:232 (EaDHAsyn2 C20 elongase domain) or SEQ ID NO:233 (EaDHAsyn3 C20 elongase domain);
  (b) a nucleotide sequence encoding a polypeptide having C20 elongase activity wherein the nucleotide sequence has at least 80% sequence identity, based on the BLASTN method of alignment, when compared to a nucleotide sequence as set forth in SEQ ID NO:11, SEQ ID NO:21, SEQ ID NO:91, SEQ ID NO:92, SEQ ID NO:93, SEQ ID NO:183, SEQ ID NO:188, SEQ ID NO:201 (EgDHAsyn1 C20 elongase domain), SEQ ID NO:206 (EgDHAsyn1*C20 elongase domain), SEQ ID NO:203 (EgDHAsyn2 C20 elongase domain), SEQ ID NO:227 (EaDHAsyn1 C20 elongase domain), SEQ ID NO:228 (EaDHAsyn2 C20 elongase domain), SEQ ID NO:229 (EaDHAsyn3 C20 elongase domain) or SEQ ID NO:230 (EaDHAsyn4 C20 elongase domain);
  (c) a nucleotide sequence encoding a polypeptide having C20 elongase activity, wherein the nucleotide sequence hybridizes under stringent conditions to a nucleotide sequence as set forth in SEQ ID NO:11, SEQ ID NO:21, SEQ ID NO:91, SEQ ID NO:92, SEQ ID NO:93, SEQ ID NO:183, SEQ ID NO:188, SEQ ID NO:201 (EgDHAsyn1 C20 elongase domain), SEQ ID NO:206 (EgDHAsyn1*C20 elongase domain), SEQ ID NO:203 (EgDHAsyn2 C20 elongase domain), SEQ ID NO:227 (EaDHAsyn1 C20 elongase domain), SEQ ID NO:228 (EaDHAsyn2 C20 elongase domain), SEQ ID NO:229 (EaDHAsyn3 C20 elongase domain) or SEQ ID NO:230 (EaDHAsyn4 C20 elongase domain); or
  (d) a complement of the nucleotide sequence of (a), (b) or (c), wherein the complement and the nucleotide sequence consist of the same number of nucleotides and are 100% complementary.

In an eighth embodiment, the invention concerns an isolated polynucleotide encoding a delta-4 desaturase comprising:
  (a) a nucleotide sequence encoding a polypeptide having delta-4 desaturase activity, wherein the polypeptide has at least 80% amino acid identity, based on the Clustal V method of alignment, when compared to an amino acid sequence as set forth in SEQ ID NO:12, SEQ ID NO:22, SEQ ID NO:95, SEQ ID NO:96, SEQ ID NO:97, SEQ ID NO:193, SEQ ID NO:215, SEQ ID NO:217, SEQ ID NO:221, SEQ ID NO:239, SEQ ID NO:240, SEQ ID NO:241, SEQ ID NO:246, SEQ ID NO:247, SEQ ID NO:248, SEQ ID NO:249, SEQ ID NO:382, SEQ ID NO:384, SEQ ID NO:386, SEQ ID NO:388, SEQ ID NO:404, SEQ ID NO:406, or SEQ ID NO:408;
  (b) a nucleotide sequence encoding a polypeptide having delta-4 desaturase activity wherein the nucleotide sequence has at least 80% sequence identity, based on the BLASTN method of alignment, when compared to a nucleotide sequence as set forth in SEQ ID NO:11, SEQ ID NO:21, SEQ ID NO:91, SEQ ID NO:92, SEQ ID NO:93, SEQ ID NO:192, SEQ ID NO:214, SEQ ID No:216, SEQ ID NO:220, SEQ ID NO:236, SEQ ID NO:237, SEQ ID NO:238, SEQ ID NO:242, SEQ ID NO:243, SEQ ID NO:244, SEQ ID NO:245, SEQ ID NO:381, SEQ ID NO:383, SEQ ID NO:385, SEQ ID NO:387, SEQ ID NO:403, SEQ ID NO:405, or SEQ ID NO:407;
  (c) a nucleotide sequence encoding a polypeptide having delta-4 desaturase activity, wherein the nucleotide sequence hybridizes under stringent conditions to a nucleotide sequence as set forth in SEQ ID NO:11, SEQ ID NO:21, SEQ ID NO:91, SEQ ID NO:92, SEQ ID NO:93, SEQ ID NO:214, SEQ ID NO:216, SEQ ID NO:220, SEQ ID NO:236, SEQ ID NO:237, SEQ ID NO:238, SEQ ID NO:242, SEQ ID NO:243, SEQ ID NO:244, SEQ ID NO:245, SEQ ID NO: 381, SEQ ID NO:383, SEQ ID NO:385, SEQ ID NO:387, SEQ ID NO:403, SEQ ID NO:405, or SEQ ID NO:407; or
  (d) a complement of the nucleotide sequence of (a), (b) or (c), wherein the complement and the nucleotide sequence consist of the same number of nucleotides and are 100% complementary.

In a ninth embodiment, the invention concerns an isolated polynucleotide encoding a DHA synthase, said polynucleotide comprising the sequence set forth in any of SEQ ID NO:11, SEQ ID NO:205, SEQ ID NO:21, SEQ ID NO:91, SEQ ID NO:92, SEQ ID NO:93, or SEQ ID NO:410.

In a tenth embodiment, the invention concerns an isolated polynucleotide encoding a C20 elongase, said isolated polynucleotide encoding a C20 elongase, said polynucleotide comprising the sequence set forth in any of SEQ ID NO:183, SEQ ID NO:188, SEQ ID NO:201 (EgDHAsyn1 C20 elongase domain, SEQ ID NO:206 (EgDHAsyn1*C20 elongase domain), SEQ ID NO:203 (EgDHAsyn2 C20 elongase domain), SEQ ID NO:227 (EaDHAsyn1 C20 elongase domain), SEQ ID NO:228 (EaDHAsyn2 C20 elongase domain), SEQ ID NO:229 (EaDHAsyn3 C20 elongase domain) or SEQ ID NO:230 (EaDHAsyn4 C20 elongase domain).

In an eleventh embodiment, the invention concerns an isolated polynucleotide encoding a delta-4 desaturase, said polynucleotide comprising the sequence set forth in SEQ ID NO:192, SEQ ID NO:214, SEQ ID NO:220, SEQ ID NO:236, SEQ ID NO:237, SEQ ID NO:238, SEQ ID NO:242, SEQ ID NO:243, SEQ ID NO:244, SEQ ID NO:245, SEQ ID NO:381, SEQ ID NO:383, SEQ ID NO:385, SEQ ID No:387, SEQ ID NO:403, SEQ ID NO:405, or SEQ ID NO:407.

In a twelfth embodiment, the invention concerns a recombinant construct comprising any of the isolated polynucleotides of the invention operably linked to at least one regulatory sequence.

In a thirteenth embodiment, the invention concerns a host cell comprising in its genome the recombinant construct of the invention. More particularly, the host cell is a recombinant microbial host cell comprising a multizyme of the invention, wherein the first enzymatic activity is a delta-9 elongase and the second enzymatic activity is a delta-8 desaturase. In another aspect, the first enzymatic activity is a C20 elongase, and the second enzymatic activity is a delta-4 desaturase.

In a fourteenth embodiment, the invention concerns a transformed *Yarrowia* sp. comprising the recombinant construct of the invention.

In a fifteenth embodiment, the invention concerns a method for transforming a cell, comprising transforming a cell with the recombinant construct of the invention and selecting those cells transformed with said recombinant construct.

In a sixteenth embodiment, the invention concerns a method for producing a transformed plant comprising transforming a plant cell with any of the polynucleotides of the invention and regenerating a plant from the transformed plant cell.

In a seventeenth embodiment, the invention concerns a method for producing yeast comprising transforming a yeast cell with any of the polynucleotides of the invention and growing yeast from the transformed yeast cell.

In an eighteenth embodiment, the invention concerns a plant comprising in its genome the recombinant construct of the invention. Also of interest are seeds obtained from such plants, oil obtained from such seeds, food or feed incorporating such oil, and a beverage incorporating the oil of the invention.

In a nineteenth embodiment, the invention concerns an isolated nucleic acid molecule which encodes a C20 elongase as set forth in SEQ ID NO:183 wherein at least 147 codons are codon-optimized for expression in *Yarrowia* sp.

In a twentieth embodiment, the invention concerns an isolated nucleic acid molecule which encodes a C20 elongase as set forth in SEQ ID NO:188 wherein at least 134 codons are codon-optimized for expression in *Yarrowia* sp.

In a twenty-first embodiment, the invention concerns an isolated nucleic acid molecule which encodes a delta-4 desaturase enzyme as set forth in SEQ ID NO:192 wherein at least 285 codons are codon-optimized for expression in *Yarrowia* sp.

In a twenty-second embodiment, the invention concerns a method for making a multizyme which comprises:
(a) linking a first polypeptide with at least a second polypeptide wherein each polypeptide has an independent and separable enzymatic activity; and
(b) evaluating the product of step (a) for the independent and separable enzymatic activities.

In a twenty-third embodiment, the invention concerns a method for altering the fatty acid profile of an oilseed plant comprising:
a) transforming an oilseed plant cell with the recombinant construct of the invention;
b) regenerating a plant from the transformed oilseed plant cell step (a), wherein the plant has an altered fatty acid profile.

In a twenty-fourth embodiment, the invention concerns an isolated polynucleotide encoding a DGLA synthase comprising:
(a) a nucleotide sequence encoding a polypeptide having DGLA synthase activity, wherein the polypeptide is set forth in SEQ ID NO:441, SEQ ID NO:454, SEQ ID NO:461, SEQ ID NO:464, SEQ ID NO:471, SEQ ID NO:515, SEQ ID NO:516, SEQ ID NO:517, SEQ ID NO:518, or SEQ ID NO:519;
(b) a nucleotide sequence encoding a polypeptide having DGLA synthase activity wherein the nucleotide sequence is set forth in SEQ ID NO:440, SEQ ID NO:446, SEQ ID NO:453, SEQ ID NO:460, SEQ ID NO:463, SEQ ID NO:470, SEQ ID NO:492, SEQ ID NO:493, SEQ ID NO:494, SEQ ID NO:495, or SEQ ID NO:496;
(c) a nucleotide sequence encoding a polypeptide having DGLA synthase activity, wherein the nucleotide sequence hybridizes under stringent conditions to a nucleotide sequence as set forth in SEQ ID NO:440, SEQ ID NO:446, SEQ ID NO:453, SEQ ID NO:460, SEQ ID NO:463, SEQ ID NO:470, SEQ ID NO:492, SEQ ID NO:493, SEQ ID NO:494, SEQ ID NO:495, or SEQ ID NO:496; or
(d) a complement of the nucleotide sequence of (a), (b) or (c), wherein the complement and the nucleotide sequence consist of the same number of nucleotides and are 100% complementary.

In a twenty-fifth embodiment, the invention concerns a method for converting linoleic acid to dihomo gamma-linolenic acid comprising:
a) providing a recombinant microbial host cell comprising:
i) a DGLA synthase comprising:
1) at least one polypeptide encoding a delta-9 elongase;
2) at least one polypeptide encoding a delta-8 desaturase; and
3) a polypeptide linker;
wherein the linker is interposed between the delta-9 elongase and the delta-8 desaturase; and
ii) a source of linoleic acid; and
b) growing the host cell of (a) under conditions whereby dihomo gamma-linolenic acid is produced.

In a twenty-sixth embodiment, the invention concerns a method for the conversion of α-linolenic acid to eicosatrienoic acid comprising:
a) providing a recombinant microbial host cell comprising:
i) a DGLA synthase comprising:
1) at least one polypeptide encoding a delta-9 elongase;
2) at least one polypeptide encoding a delta-8 desaturase; and
3) a polypeptide linker;

wherein the linker is interposed between the delta-9 elongase and the delta-8 desaturase; and
ii) a source of α-linolenic acid; and
b) growing the host cell of (a) under conditions whereby eicosatrienoic acid is produced.

In a twenty-seventh embodiment, the invention concerns a method for the conversion of eicosapentaenoic acid to docosahexaenoic acid comprising:
a) providing a recombinant microbial host cell comprising:
i) a DHA synthase comprising:
1) at least one polypeptide encoding a C20 elongase;
2) at least one polypeptide encoding a delta-4 desaturase; and
3) a polypeptide linker;
wherein the linker is interposed between the C20 elongase and the delta-4 desaturase; and
ii) a source of eicosapentaenoic acid; and
b) growing the host cell of (a) under conditions whereby docosahexaenoic acid is produced.

In a twenty-eighth embodiment, the invention concerns a method for the conversion of arachidonic acid to docosapentaenoic acid comprising:
a) providing a recombinant microbial host cell comprising:
i) a DHA synthase comprising:
1) at least one polypeptide encoding a C20 elongase;
2) at least one polypeptide encoding a delta-4 desaturase; and
3) a polypeptide linker;
wherein the linker is interposed between the C20 elongase and the delta-4 desaturase; and
ii) a source of arachidonic acid; and
b) growing the host cell of (a) under conditions whereby docosapentaenoic acid is produced.

In a twenty-ninth embodiment, the invention concerns a method for the identification of a polypeptide having improved delta-4 desaturase activity comprising:
a) providing a wild-type delta-4 desaturase polypeptide isolated from *Euglena anabena* having a base-line delta-4 desaturase activity;
b) truncating the wild-type polypeptide of (a) by from about 1 to about 200 amino acids to create a truncated mutant polypeptide having delta-4 desaturase activity that is increased as compared with the base-line delta-4 desaturase activity.

In a thirtieth embodiment, the invention concerns a microbial host cell which produces a polyunsaturated fatty acid and expresses polypeptides encoding enzymes in the following sequential pathway:
1) a delta-9 desaturase,
2) a delta-12 desaturase,
3) a delta-9 elongase,
4) a delta-8 desaturase,
5) a delta-5 desaturase,
6) a delta-17 desaturase,
7) a $C_{20/22}$ elongase, and
8) a delta-4 desaturase;
wherein the polypeptides comprise at least one multizyme, a fusion comprising a fusion between at least one contiguous enzyme pair.

Biological Deposits

The following biological materials have been deposited with the American Type Culture Collection (ATCC), 10801 University Boulevard, Manassas, Va. 20110-2209, and bear the following designations, Accession Numbers and dates of deposit (Table 1).

TABLE 1

| ATCC Deposit | | |
|---|---|---|
| Description | Accession Number | Date of Deposit |
| Plasmid pKR72 | ATCC PTA-6019 | May 28, 2004 |
| *Yarrowia lipolytica* Y4128 | ATCC PTA-8614 | Aug. 23, 2007 |
| *Yarrowia lipolytica* Y4127 | ATCC PTA-8802 | Nov. 29, 2007 |

BRIEF DESCRIPTION OF THE DRAWINGS AND SEQUENCE LISTINGS

The invention can be more fully understood from the following detailed description and the accompanying drawings and Sequence Listing, which form a part of this application.

FIG. 1 is a representative omega-3 and omega-6 fatty acid pathway providing for the conversion of myristic acid through various intermediates to DHA.

FIG. 2 shows a Clustal W alignment between a portion of the coding sequence of EgDHAsyn2 (SEQ ID NO:21), the cDNA sequence of the *Euglena gracilis* delta-4 desaturase (SEQ ID NO:23) (NCBI Accession No. AY278558 (GI 33466345), locus AY278558, Meyer et al., Biochemistry 42(32):9779-9788 (2003)), and the coding sequence of the *Euglena gracilis* delta-4 desaturase (SEQ ID NO:24) (Meyer et al., supra).

FIGS. 3A and 3B show a Clustal W alignment between the amino acid sequence of EgDHAsyn1 (SEQ ID NO:12), EgDHAsyn2 (SEQ ID NO:22), and EgC20elo1 (SEQ ID NO:6).

FIGS. 4A and 4B show the Clustal W alignment of the N-terminus of EgDHAsyn1 (SEQ ID NO:12) and the N-terminus of EgDHAsyn2 (SEQ ID NO:22) with EgC20elo1 (SEQ ID NO:6), *Pavlova* sp. CCMP459 C20-PUFA Elo (SEQ ID NO:2), *Ostreococcus tauri* PUFA elongase 2 (SEQ ID NO:25) (NCBI Accession No. AAV67798 (GI 55852396), locus AAV67798, CDS AY591336; Meyer et al., *J. Lipid Res.* 45(10):1899-1909 (2004)), and *Thalassiosira pseudonana* PUFA elongase 2 (SEQ ID NO:26) (NCBI Accession No. AAV67800 (GI 55852441), locus AAV67800, CDS AY591338; Meyer et al., *J. Lipid Res.* 45(10):1899-1909 (2004)).

Figure 5A:
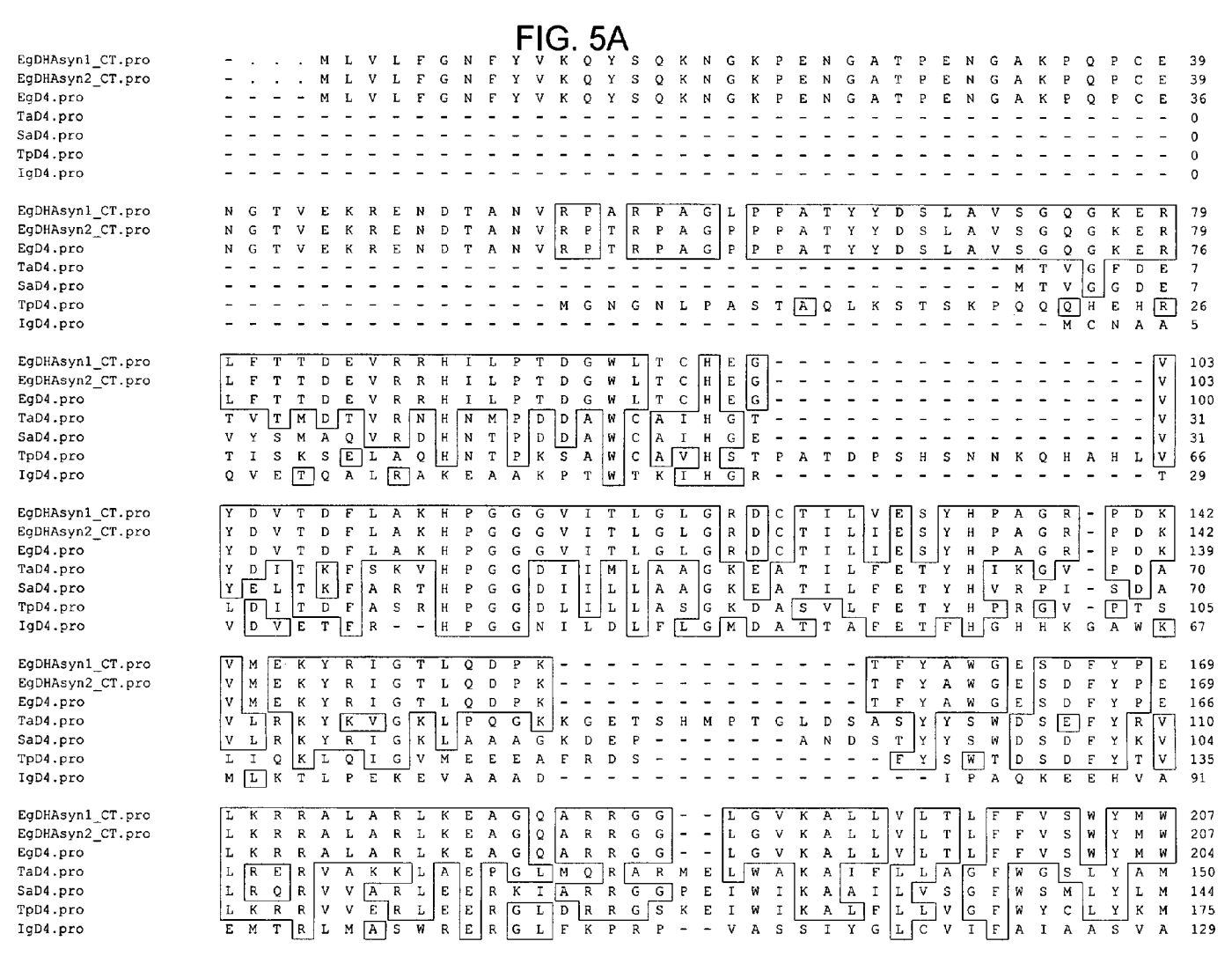
Figure 5B:
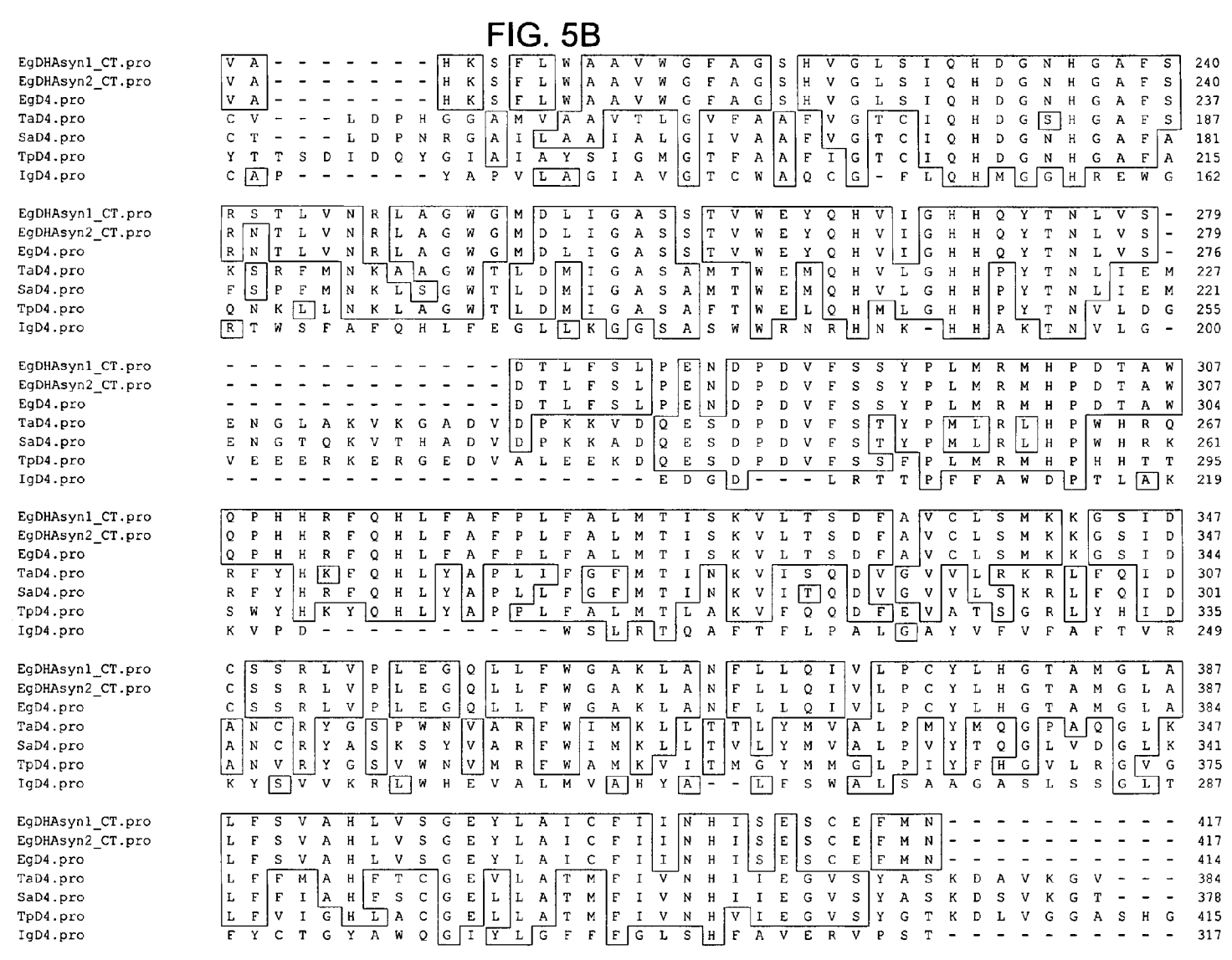

FIGS. 5A, 5B, 5C and 5D show the Clustal W alignment of the C-terminus of EgDHAsyn1 (EgDHAsyn1_CT; amino acids 253-793 of SEQ ID NO:12; the N-terminus of EgDHAsyn1 is not shown and is indicated by " . . . ") and the C-terminus of EgDHAsyn2 (EgDHAsyn2_CT; amino acids 253-793 of SEQ ID NO:22, the N-terminus of EgDHAsyn2 is not shown and is indicated by " . . . ") with *Euglena gracilis* delta-4 fatty acid desaturase (SEQ ID NO:13), *Thraustochytrium aureum* delta-4 desaturase (SEQ ID NO:27) (NCBI Accession No. AAN75707(GI 25956288), locus MN75707, CDS AF391543), *Schizochytrium aggregatum* delta-4 desaturase (SEQ ID NO:28) (PCT Publication No. WO 2002/090493), *Thalassiosira pseudonana* delta-4 desaturase (SEQ ID NO:29) (NCBI Accession No. AAX14506 (GI 60173017), locus AAX14506, CDS AY817156; Tonon et al., *FEBS J.* 272 (13):3401-3412 (2005)), and *Isochrysis galbana* delta-4 desaturase (SEQ ID NO:30) (NCBI Accession No. AAV33631 (GI 54307110), locus AAV33631, CDS AY630574; Pereira et al., *Biochem. J.*, 384(2):357-366 (2004) and PCT Publication No. WO 2002/090493).

FIG. 6 shows an alignment of interior fragments of EgDHAsyn1 (EgDHAsyn1_NCT; amino acids 253-365 of SEQ ID NO:12) and EgDHAsyn2 (EgDHAsyn2_NCT; amino acids 253-365 of SEQ ID NO:22) spanning both the C20 elongase region and the delta-4 desaturase domain (based on homology) with the C-termini of C20 elongases (EgC20elo1_CT, amino acids 246-298 of SEQ ID NO:6; PavC20elo_CT, amino acids 240-277 of SEQ ID NO:2; OtPUFAelo2_CT, amino acids 256-300 of SEQ ID NO:25; TpPUFAelo2_CT, amino acids 279-358 of SEQ ID NO:26) and the N-termini of delta-4 desaturases (EgD4_NT, amino acids 1-116 of SEQ ID NO:13; TaD4_NT, amino acids 1-47 of SEQ ID NO:27; SaD4_NT, amino acids 1-47 of SEQ ID NO:28; TpD4_NT, amino acids 1-82 of SEQ ID NO:29; IgD4_NT, amino acids 1-43 of SEQ ID NO:30).

FIG. 7 provides plasmid maps for the following: (A) pY115 (see also SEQ ID NO:33); (B) *Yarrowia lipolytica* Gateway® destination vector pBY1 (see also SEQ ID NO:34); (C) *Yarrowia lipolytica* Gateway® destination vector pY159 (see also SEQ ID NO:38); and (D) pBY-EgC20elo1 (see also SEQ ID NO:39).

FIG. 8 provides plasmid maps for the following: (A) pY132 (see also SEQ ID NO:40); (B) pY161 (see also SEQ ID NO:41); (C) pY164 (see also SEQ ID NO:42); and (D) pY141 (see also SEQ ID NO:49).

FIG. 9 provides plasmid maps for the following: (A) pY143 (see also SEQ ID NO:52); (B) pY149 (see also SEQ ID NO:55); (C) pY150 (see also SEQ ID NO:62); and (D) pY156 (see also SEQ ID NO:64).

FIG. 10 provides plasmid maps for the following: (A) pY152 (see also SEQ ID NO:67); (B) pY157 (see also SEQ ID NO:69); (C) pY153 (see also SEQ ID NO:72); and (D) pY151 (see also SEQ ID NO:76).

FIGS. 13A, 13B and 13C show a Clustal W alignment of the amino acid sequences for EaDHAsyn1 (SEQ ID NO:95), EaDHAsyn2 (SEQ ID NO:96), EaDHAsyn3 (SEQ ID NO:97), and EaDHAsyn4 (SEQ ID NO:98).

Figure 14:
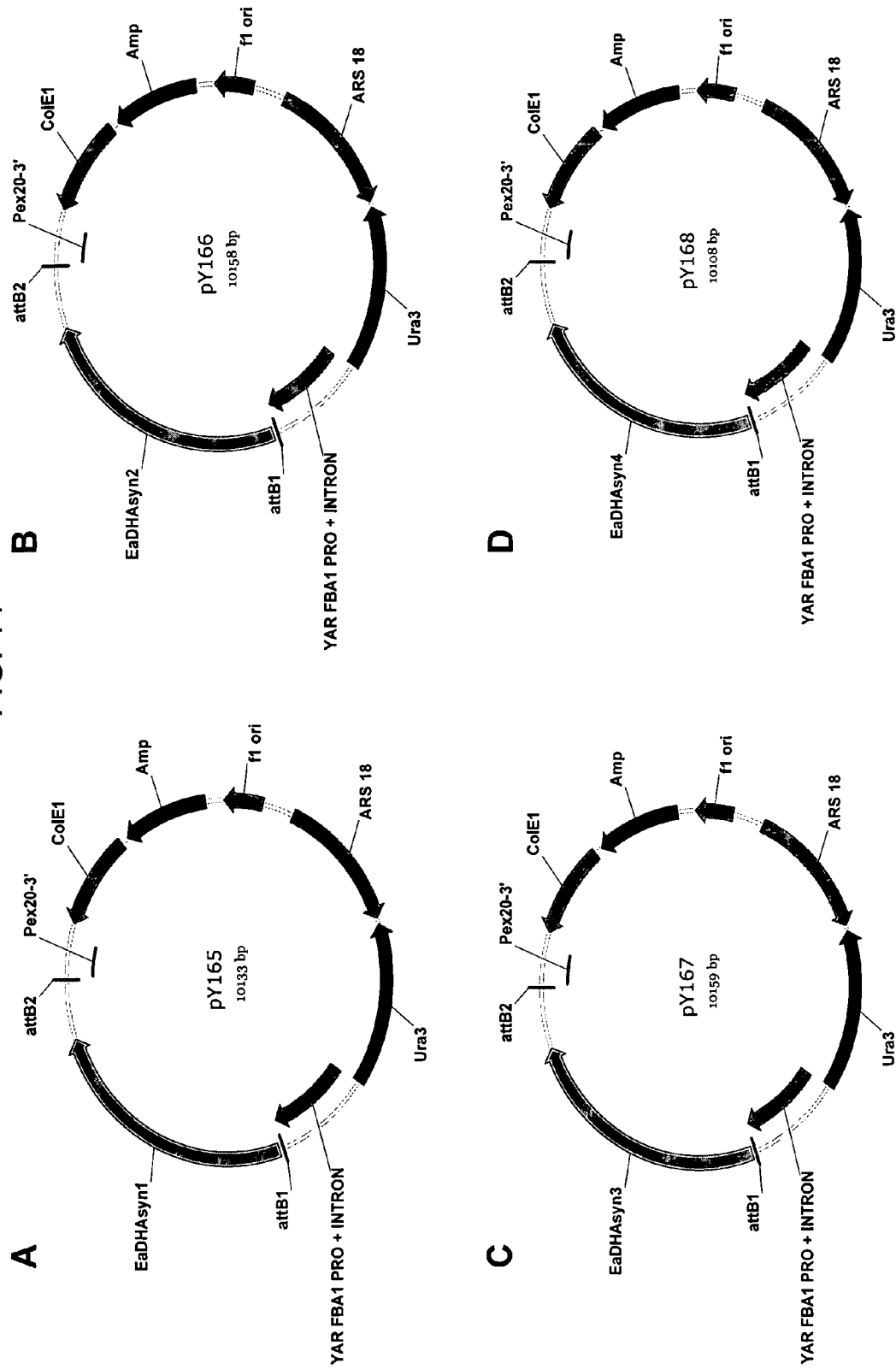

FIG. 14 provides plasmid maps for the following: (A) pY165 (see also SEQ ID NO:99); (B) pY166 (see also SEQ ID NO:100); (C) pY167 (see also SEQ ID NO:101); and (D) pY168 (see also SEQ ID NO:102).

Figure 15:
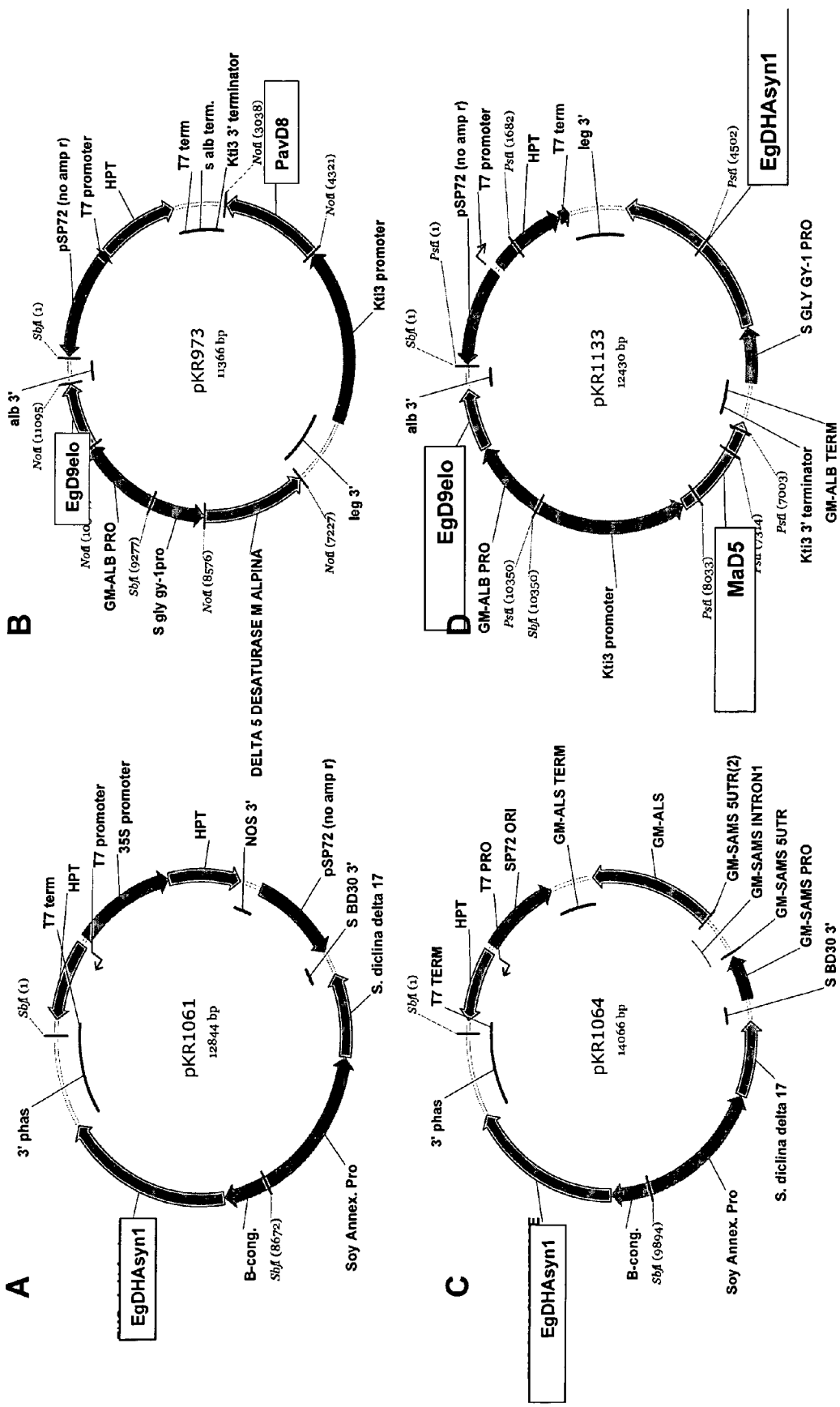

FIG. 15 provides plasmid maps for the following: (A) pKR1061 (see also SEQ ID NO:111); (B) pKR973 (see also SEQ ID NO:128); (C) pKR1064 (see also SEQ ID NO:132); and (D) pKR1133 (see also SEQ ID NO:145).

Figure 16:
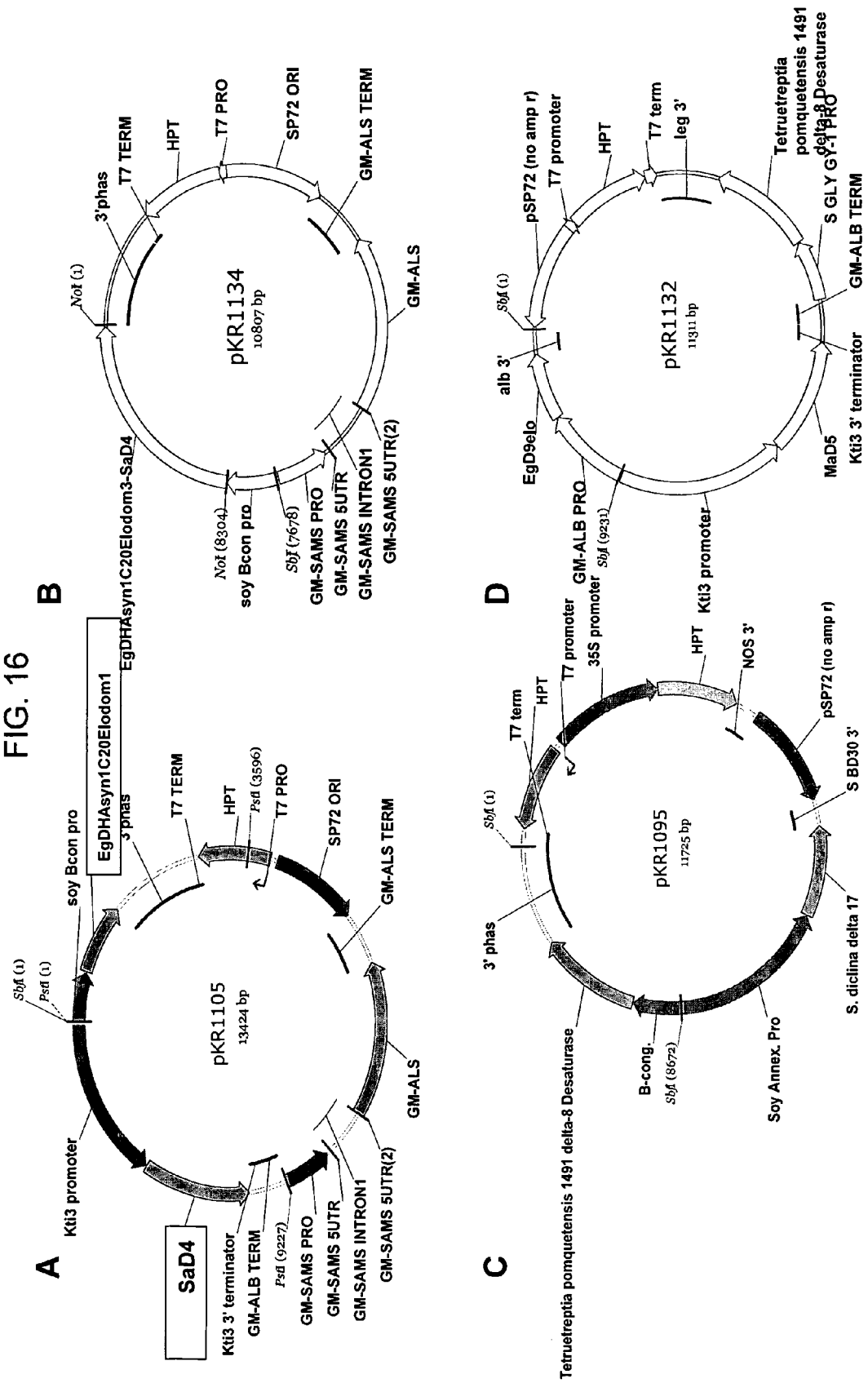

FIG. 16 provides plasmid maps for the following: (A) pKR1105 (see also SEQ ID NO:156); (B) pKR1134 (see also SEQ ID NO:161); (C) pKR1095 (see also SEQ ID NO:167); and (D) pKR1132 (see also SEQ ID NO:170.

Figure 17:
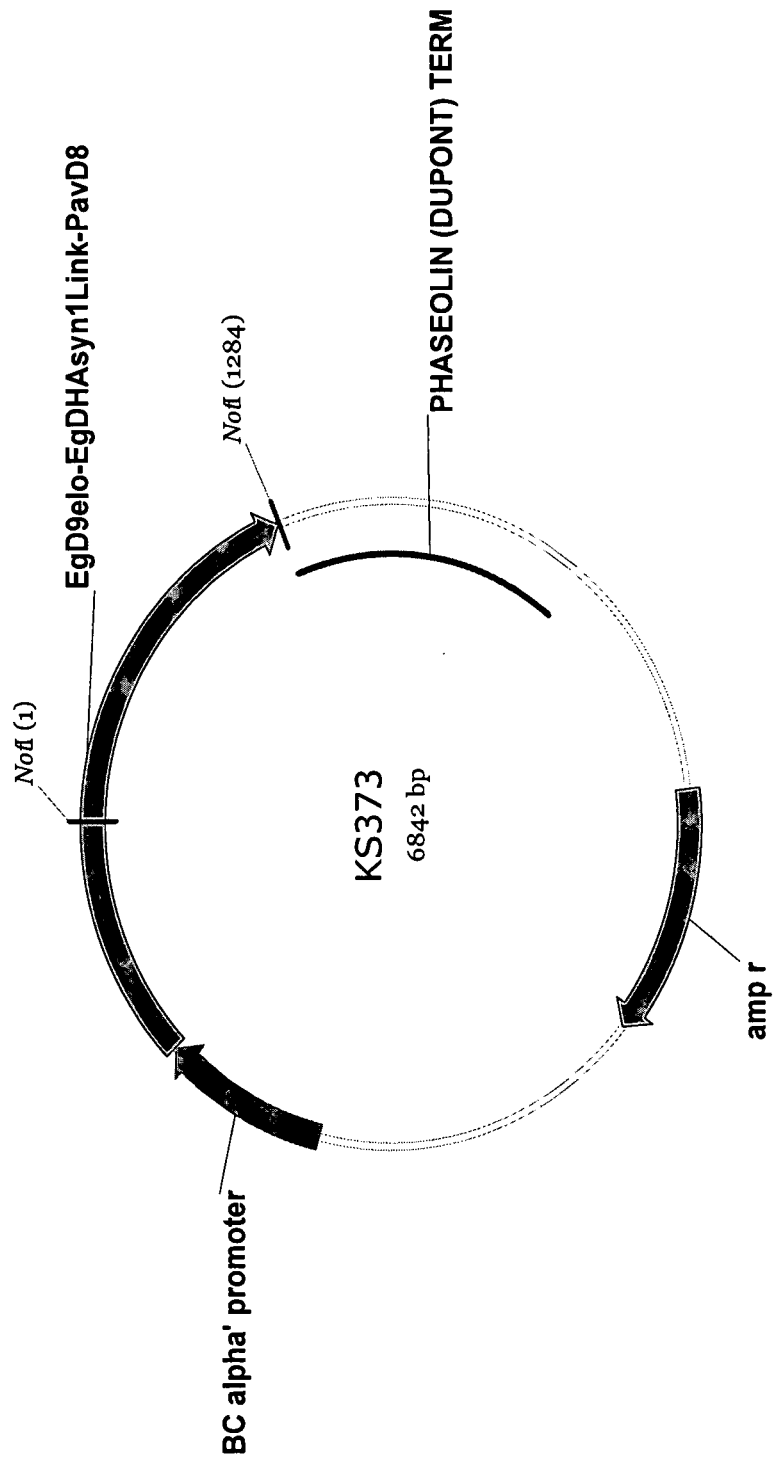

FIG. 17 is a map of KS373 (see also SEQ ID NO:179).

FIG. 18 shows the fatty acid profiles, calculated % elongation, and calculated % desaturation for the clones (except pBY-EgC20elo1) shown in Table 24.

FIG. 19 shows the fatty acid profiles, calculated % elongation, and calculated % desaturation for feeding EPA to a vector only control, pY141, pY143, pY149, pY156, pY157, and pY160.

FIG. 20 shows the fatty acid profiles, calculated % elongation, and calculated % desaturation for feeding DPA to a vector only control, pY141, pY150, pY151, pY152, pY153, pY156, pY157, and pY160.

Figure 21:
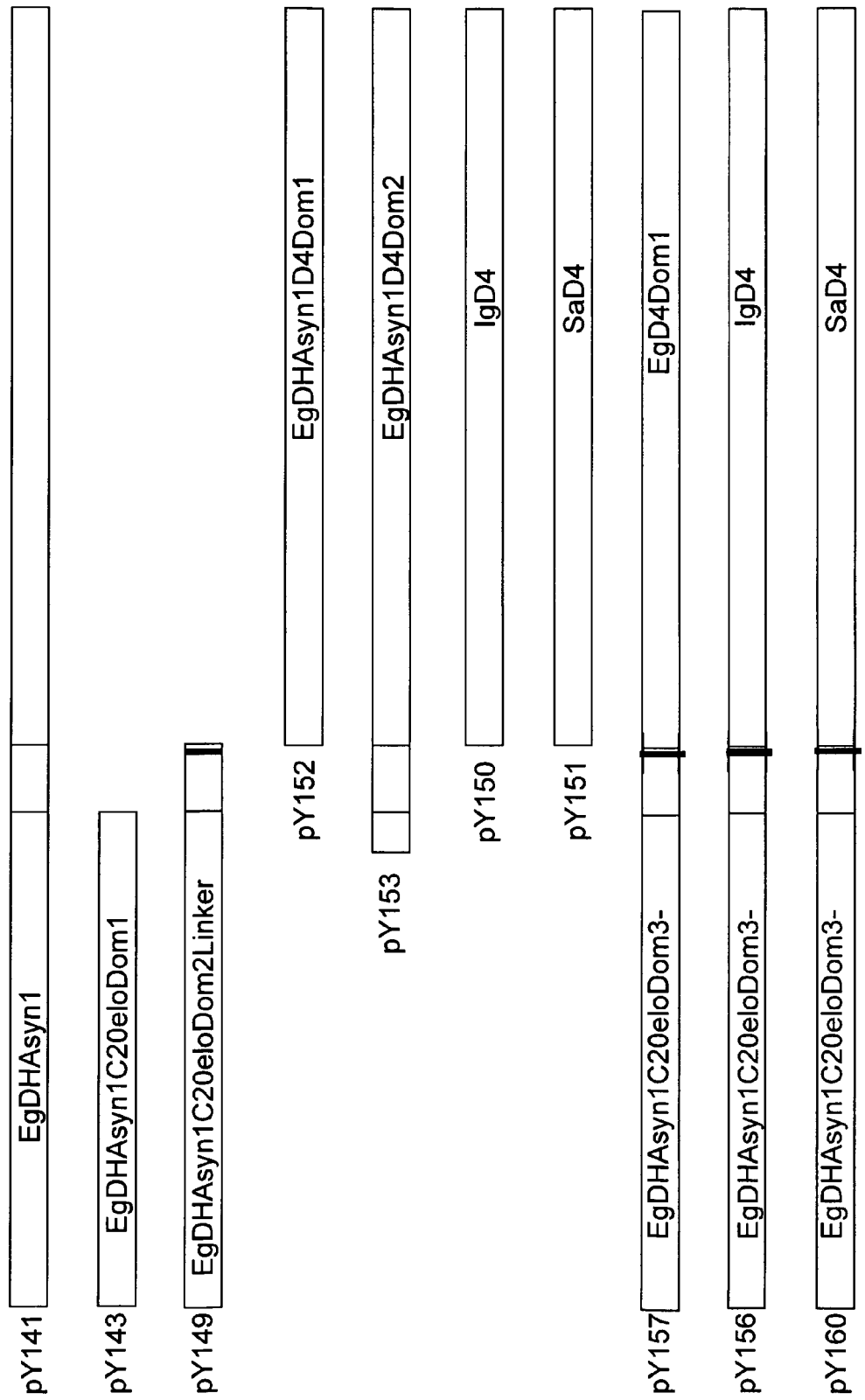

FIG. 21 shows a schematic of the relative domain structure for each construct described in Table 25.

FIG. 22 shows the fatty acid profiles, calculated % elongation, and calculated % desaturation for feeding EPA, ARA, and DPA to *Yarrowia* cells transformed with pY141 (EgDHAsyn1; SEQ ID NO:49) and to a vector only control.

FIG. 23 shows the fatty acid profiles for individual embryos from a representative event in somatic soybean embryos transformed with soybean expression vectors pKR973 and pKR1064 (see Table 26).

FIG. 24 shows the fatty acid profiles from the five best elongation events in soybean embryos transformed with soybean expression vector KS373.

FIG. 25 summarizes BLASTP and percent identity values for EgC20elo1 (Example 3), EgDHAsyn1 (Example 4), and EgDHAsyn2 (Example 5).

FIG. 26 shows the fatty acid profiles from feeding soybean embryos with EPA. The soybean embryos were selected from the best C20/delta-5 elongase and delta-4 desaturase activities in soybean embryos transformed with soybean expression vector pKR1105.

Figure 27:
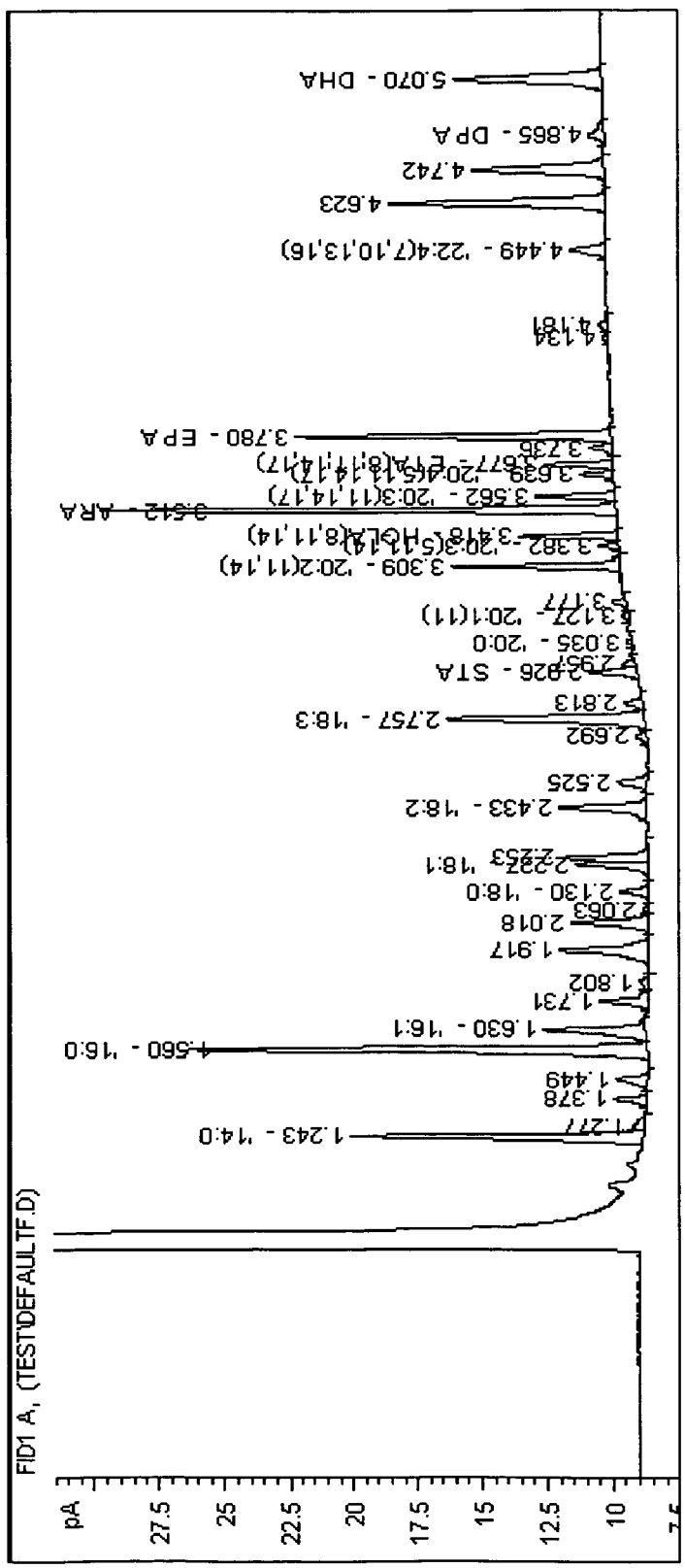

FIG. 27 shows a chromatogram of the lipid profile of a *Euglena gracilis* cell extract as described in the Examples.

Figure 28:
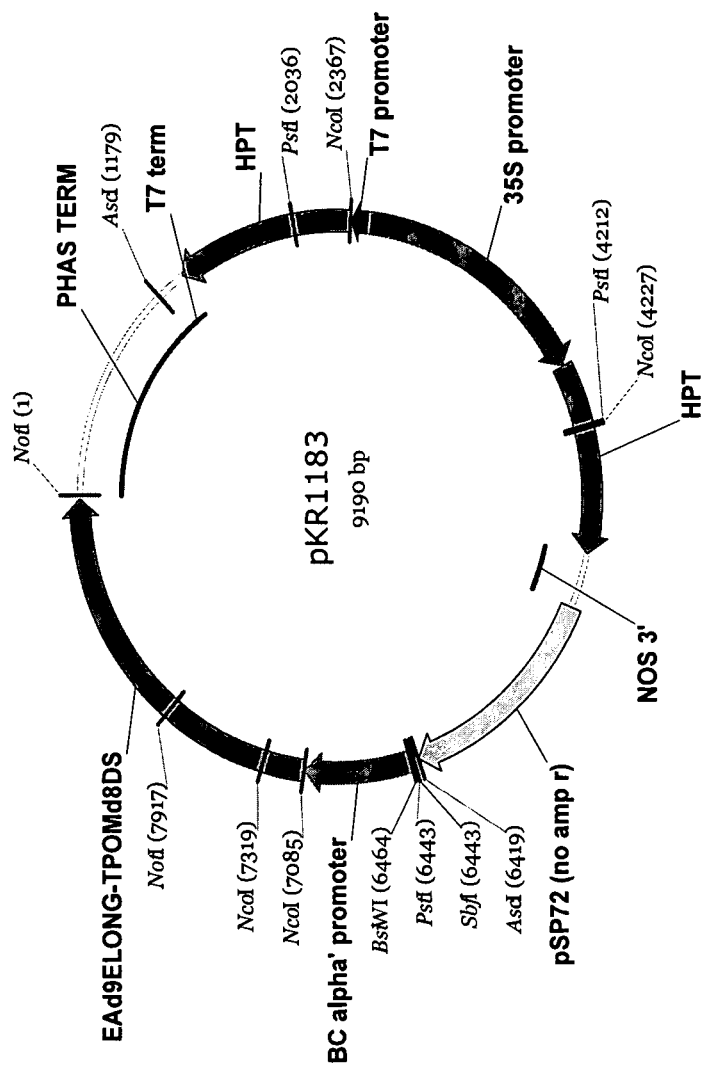

FIG. 28 is a map of pKR1183 (see also SEQ ID NO:266).

FIG. 29 summarizes the *Euglena anabaena* DHA synthase domain sequences.

Figure 30:
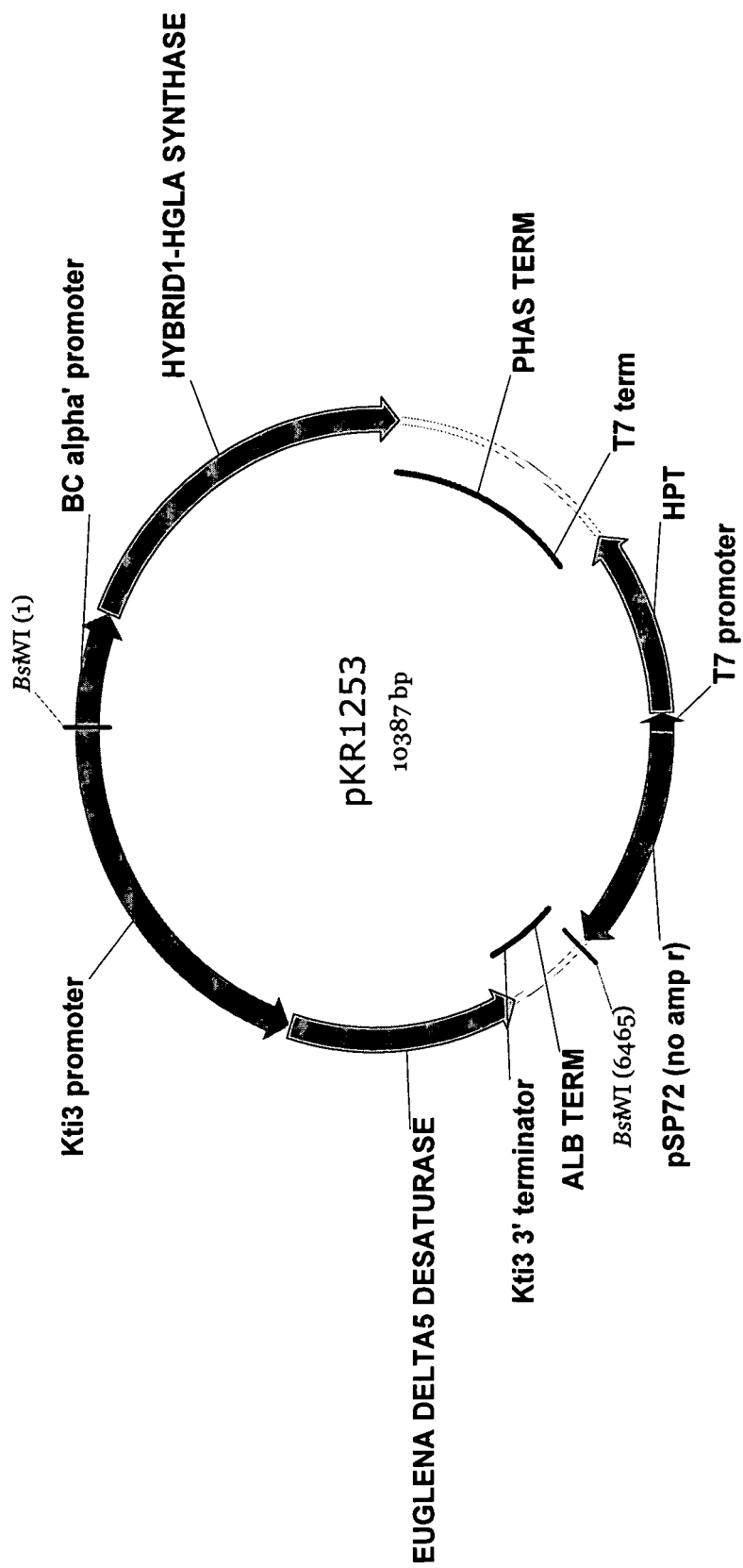

FIG. 30 is a map of pKR1253 (see also SEQ ID NO:270).

Figure 31:
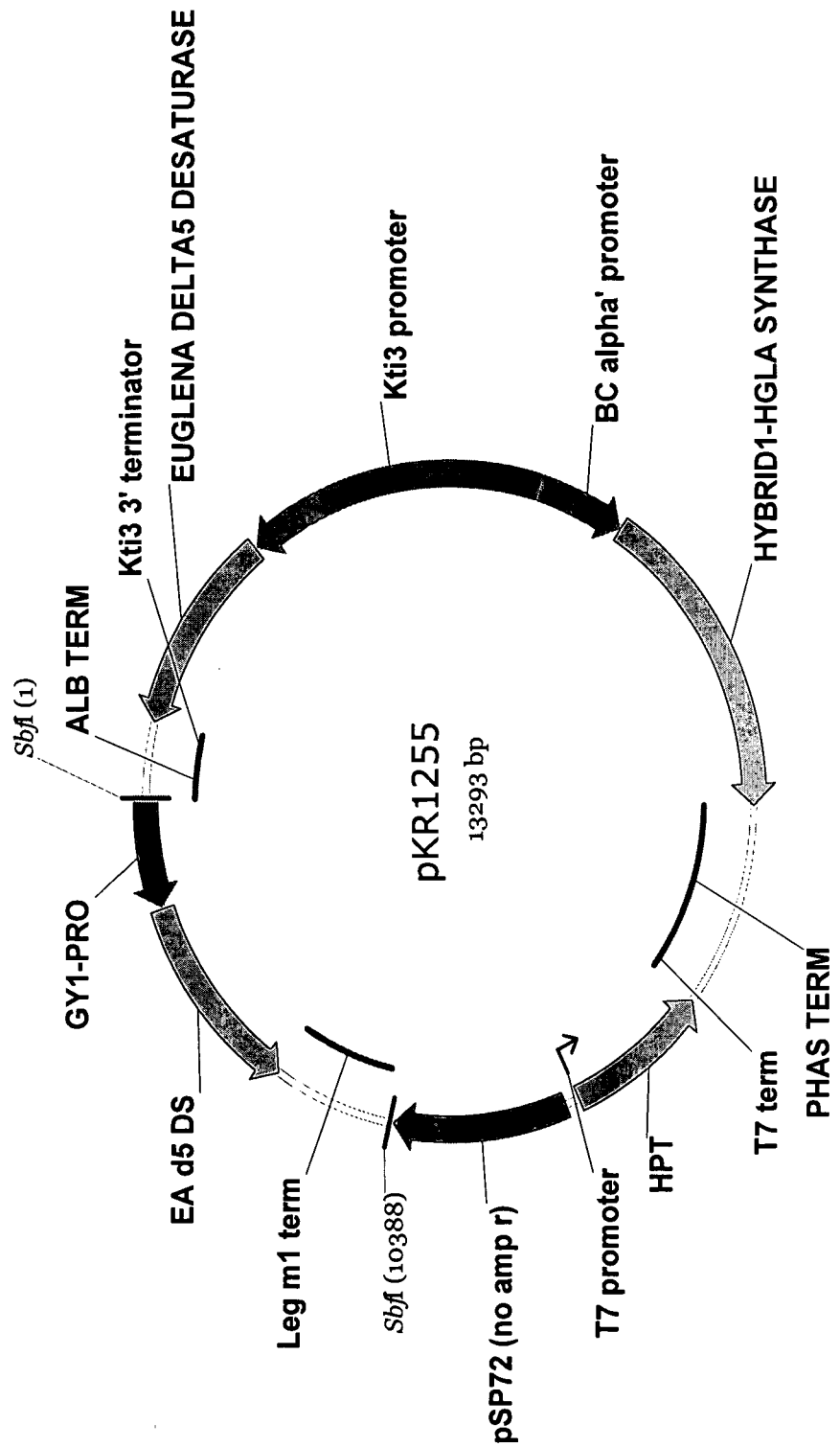

FIG. 31 is a map of pKR1255 (see also SEQ ID NO:275).

Figure 32:
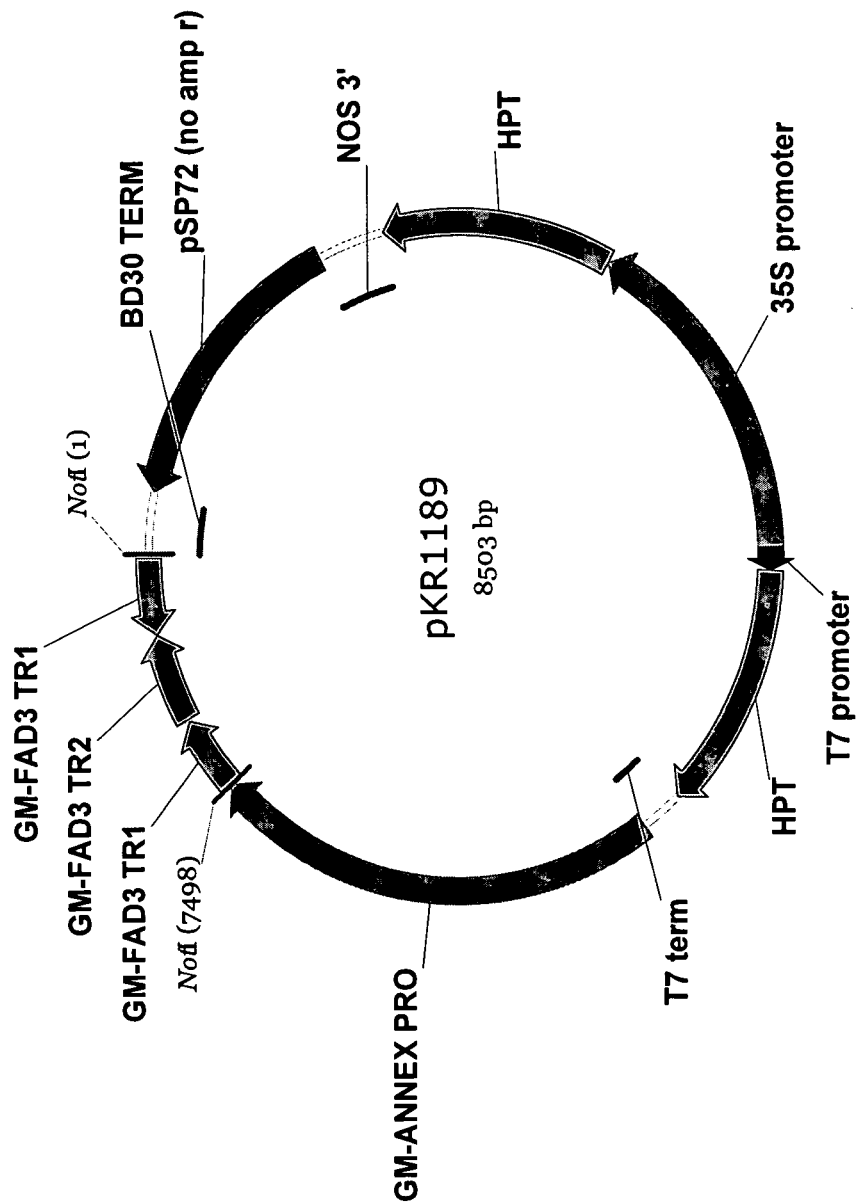

FIG. 32 is a map of pKR1189 (see also SEQ ID NO:285).

Figure 33:
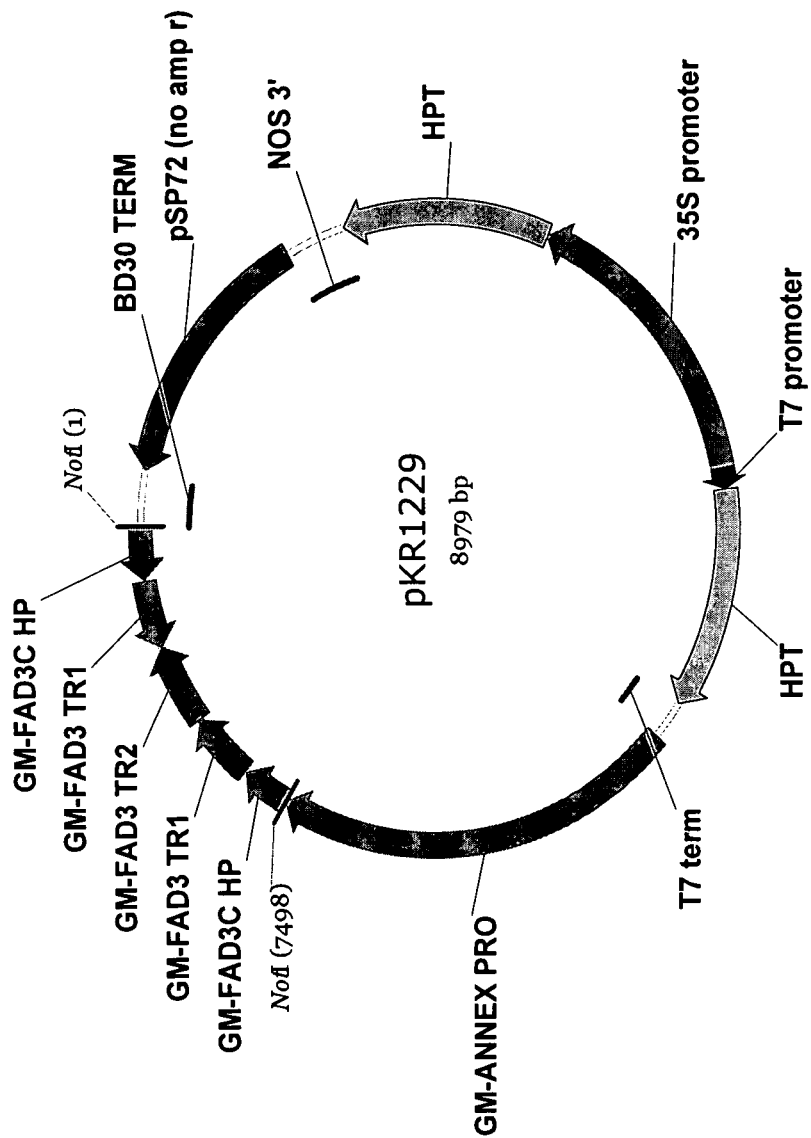

FIG. 33 is a map of pKR1229 (see also SEQ ID NO:296).

Figure 34:
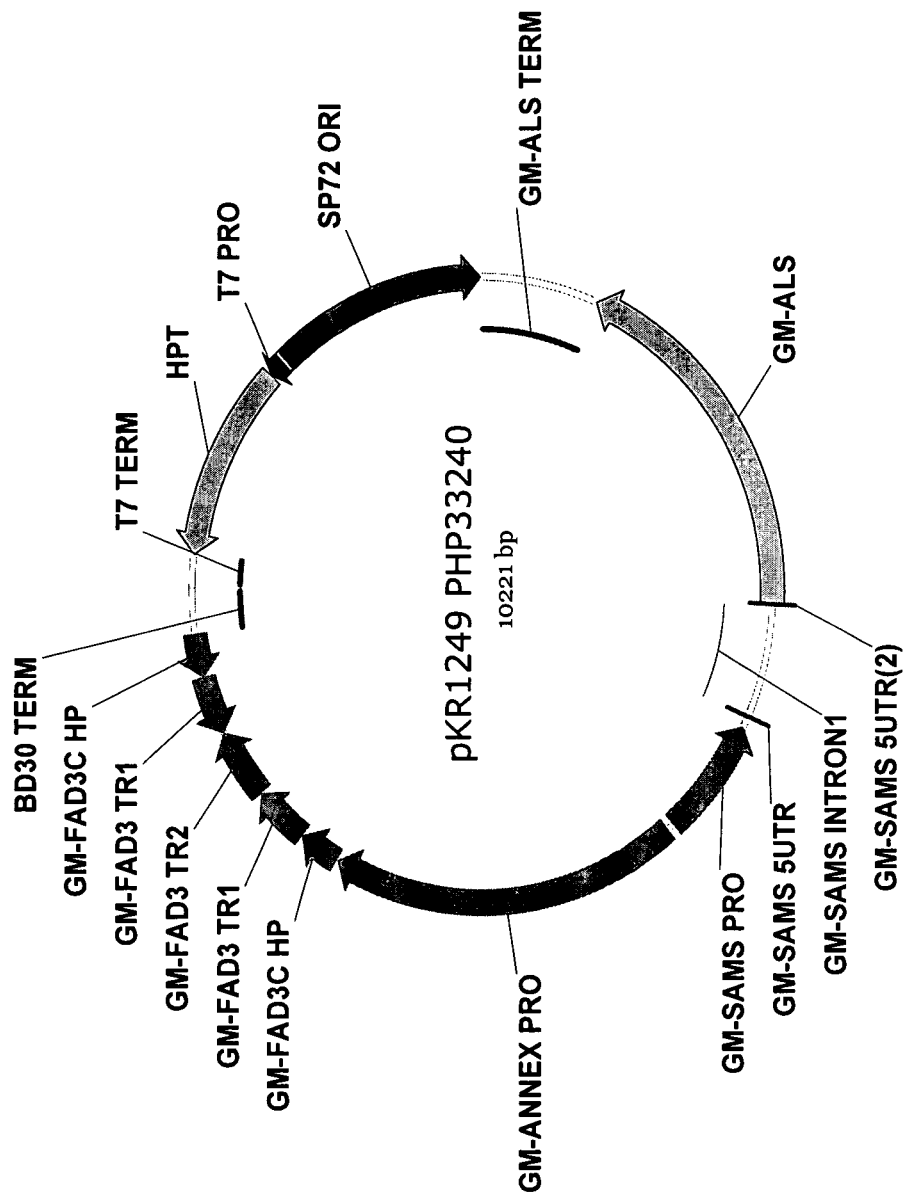

FIG. 34 is a map of pKR1249 (see also SEQ ID NO:297).

Figure 35:
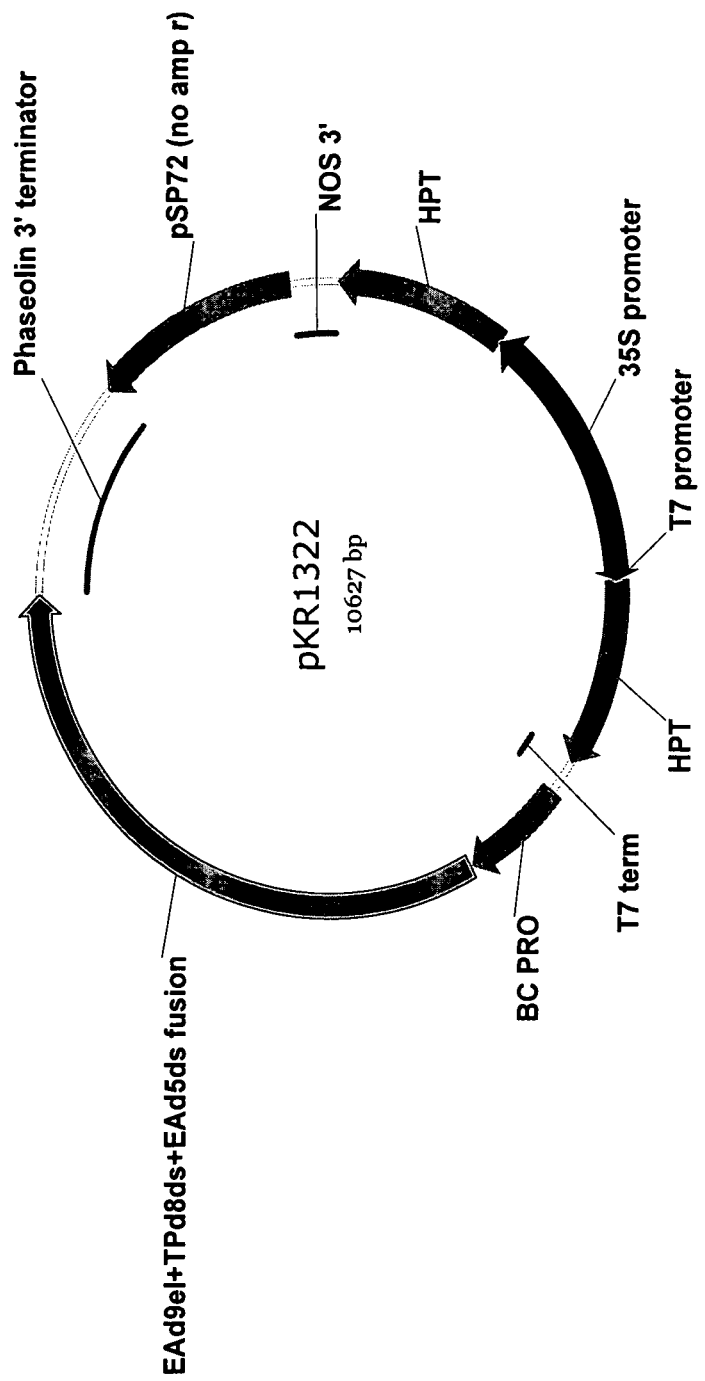

FIG. 35 is a map of pKR1322 (see also SEQ ID NO:314).

FIG. 36 shows the fatty acid profiles for five events transformed with pKR1189 that have the lowest average ALA content (average of 5 soybean somatic embryos analyzed) along with an event (2148-3-8-1) having a fatty acid profile typical of wild type embryos for this experiment. Fatty acids are identified as 16:0 (palmitate), 18:0 (stearic acid), 18:1 (oleic acid), LA, and ALA. Fatty acid compositions are expressed as a weight percent (wt. %) of total fatty acids.

FIG. 37 shows the fatty acid profiles for five events transformed with pKR1183 that have the highest average DGLA content (average of 5 soybean somatic embryos analyzed). Fatty acids are identified as 16:0 (palmitate), 18:0 (stearic acid), 18:1 (oleic acid), LA, ALA, EDA, ERA, DGLA, and ETA. Fatty acid compositions are expressed as a weight percent (wt. %) of total fatty acids.

FIG. 38 shows the average fatty acid profiles (Average of 10 soybean somatic embryos) for 20 events transformed with pKR1249 and pKR1253 that have the highest ARA. Fatty acids are identified as 16:0 (palmitate), 18:0 (stearic acid), 18:1 (oleic acid), LA, ALA, EDA, SCI, DGLA, ARA, ERA, JUN, ETA, and EPA. Fatty acid compositions are expressed as a weight percent (wt. %) of total fatty acids. Fatty acids listed as "others" include: 18:2 (5,9), 18:3 (5,9,12), STA, 20:0, 20:1(11), 20:2 (7,11) or 20:2 (8,11), and DPA.

FIG. 39 shows the actual fatty acid profiles for each soybean somatic embryo from one event (AFS 5416-8-1-1) having an average ARA content of 17.0% and an average EPA content of 1.5%. Fatty acids are identified as 16:0 (palmitate), 18:0 (stearic acid), 18:1 (oleic acid), LA, ALA, EDA, SCI, DGLA, ARA, ERA, JUN, ETA, and EPA. Fatty acid compositions are expressed as a weight percent (wt. %) of total fatty acids. Fatty acids listed as "others" include: 18:2 (5,9), 18:3 (5,9,12), STA, 20:0, 20:1(11), 20:2 (7,11) or 20:2 (8,11), and DPA.

FIG. 40 shows the average fatty acid profiles (Average of 9 or 10 soybean somatic embryos) for 20 events transformed with pKR1249 and pKR1255 that have the highest ARA. Fatty acids are identified as 16:0 (palmitate), 18:0 (stearic acid), 18:1 (oleic acid), LA, ALA, EDA, SCI, DGLA, ARA, ERA, JUN, ETA, and EPA; fatty acid compositions are expressed as a weight percent (wt. %) of total fatty acids. Fatty acids listed as "others" include: 18:2 (5,9), 18:3 (5,9, 12), STA, 20:0, 20:1(11), 20:2 (7,11) or 20:2 (8,11), and DPA.

FIG. 41 shows the fatty acid profiles from feeding embryos with EPA. The soybean embryos were selected from the events with the best C20/delta-5 elongase and delta-4 desaturase activities in soybean embryos transformed with soybean expression vector pKR1134. Fatty acids in FIG. 41 are identified as 16:0 (palmitate), 18:0 (stearic acid), 18:1 (oleic acid), LA, ALA, EPA, 22:0 (docosanoic acid), DPA, 24:0 (tetracosanoic acid), DHA, and 24:1 (nevonic acid). Fatty acid compositions listed in FIG. 41 are expressed as a weight percent (wt. %) of total fatty acids.

FIG. 42 shows the fatty acid profiles from feeding soybean embryos with EPA. The soybean embryos were selected from the events with the best C20/delta-5 elongase and delta-4 desaturase activities from the 20 new events analyzed for soy transformed with pKR1105. Fatty acids in FIG. 42 are identified as 16:0 (palmitate), 18:0 (stearic acid), 18:1 (oleic acid), LA, ALA, EPA, 22:0 (docosanoic acid), DPA, 24:0 (tetracosanoic acid), DHA, and 24:1 (nevonic acid). Fatty acid compositions listed in FIG. 42 are expressed as a weight percent (wt. %) of total fatty acids.

Figure 43:
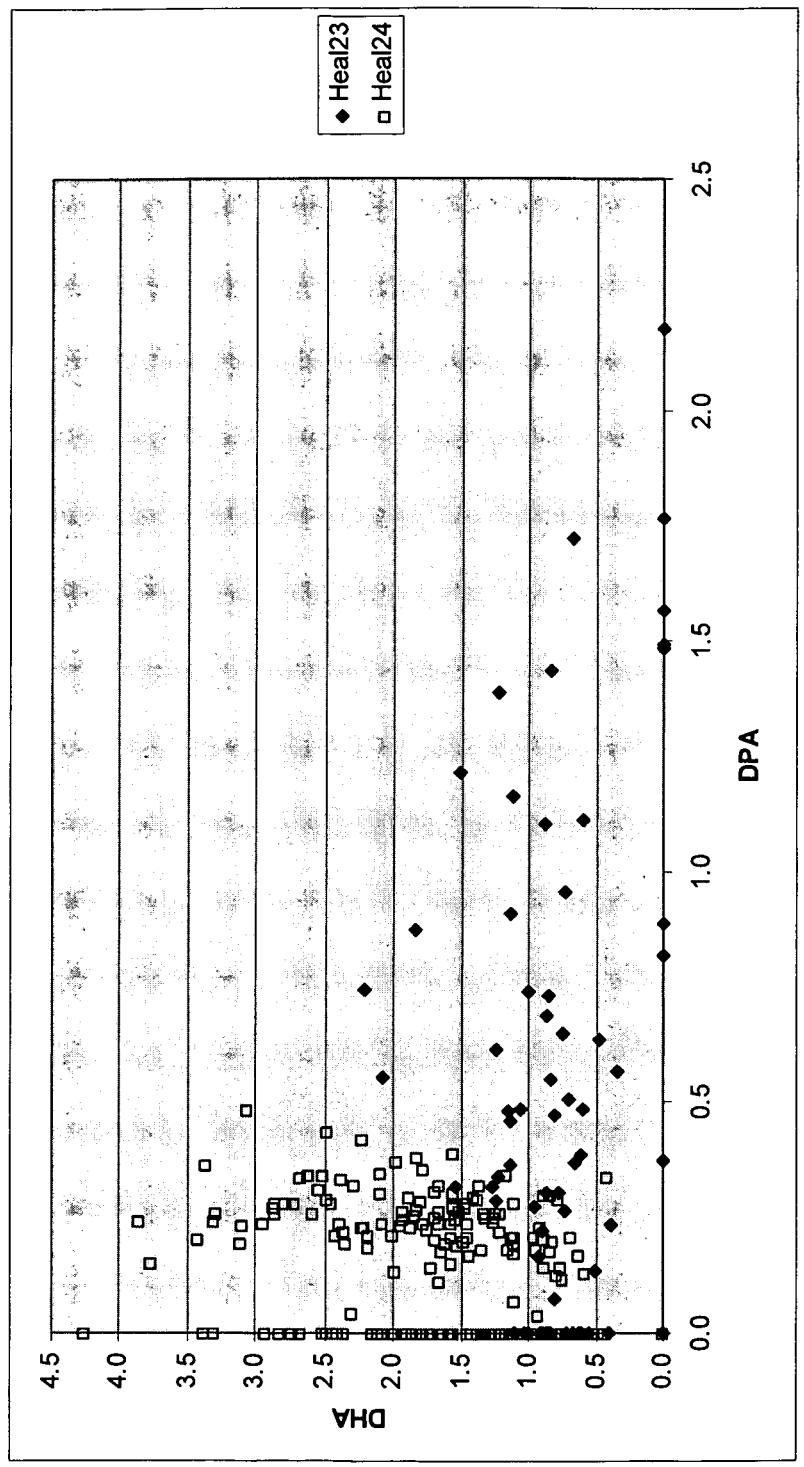

FIG. 43 shows a graph depicting the relative activities of events transformed with either pKR1105 (C20 elongase and delta-4 desaturase expressed individually) or pKR1134 (C20 elongase and delta-4 desaturase expressed as a fusion), when the soybean embryos were fed EPA.

Figure 44:
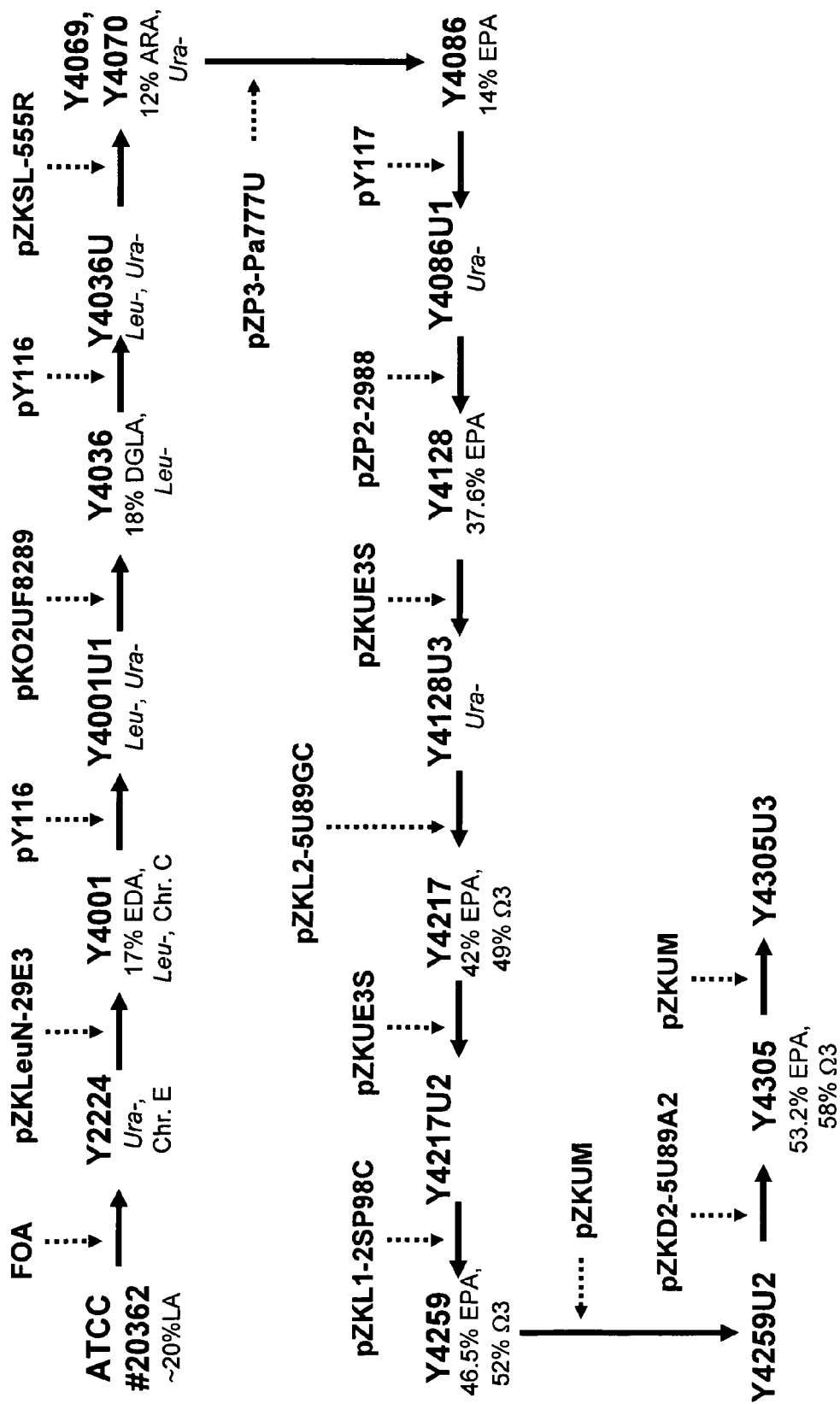

FIG. 44 diagrams the development of *Yarrowia lipolytica* strain Y4305U3.

Figure 45:
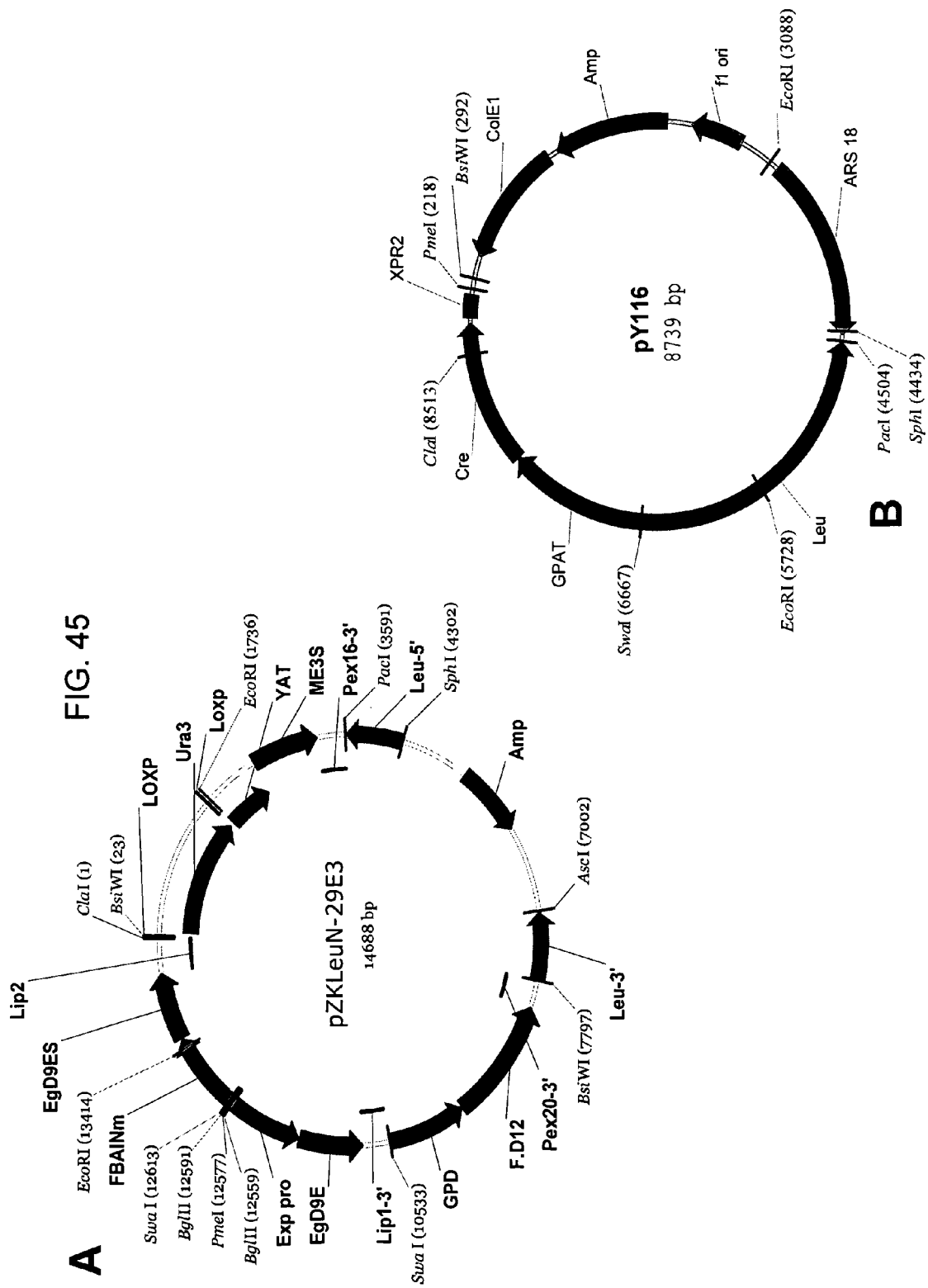

FIG. 45 provides plasmid maps for the following: (A) pZKLeuN-29E3 and (B) pY116.

Figure 46:
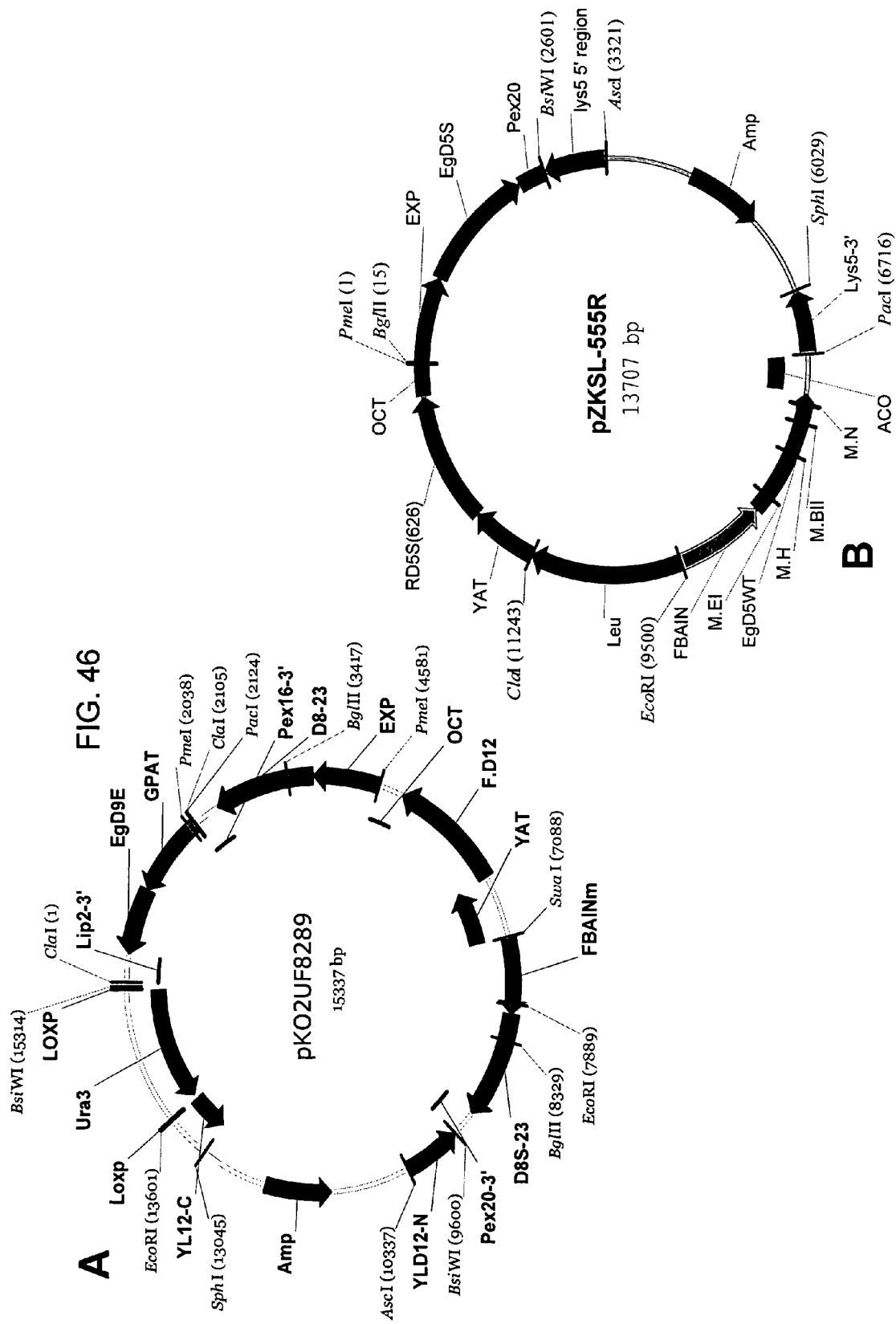

FIG. 46 provides plasmid maps for the following: (A) pKO2UF8289 and (B) pZKSL-555R.

Figure 47:
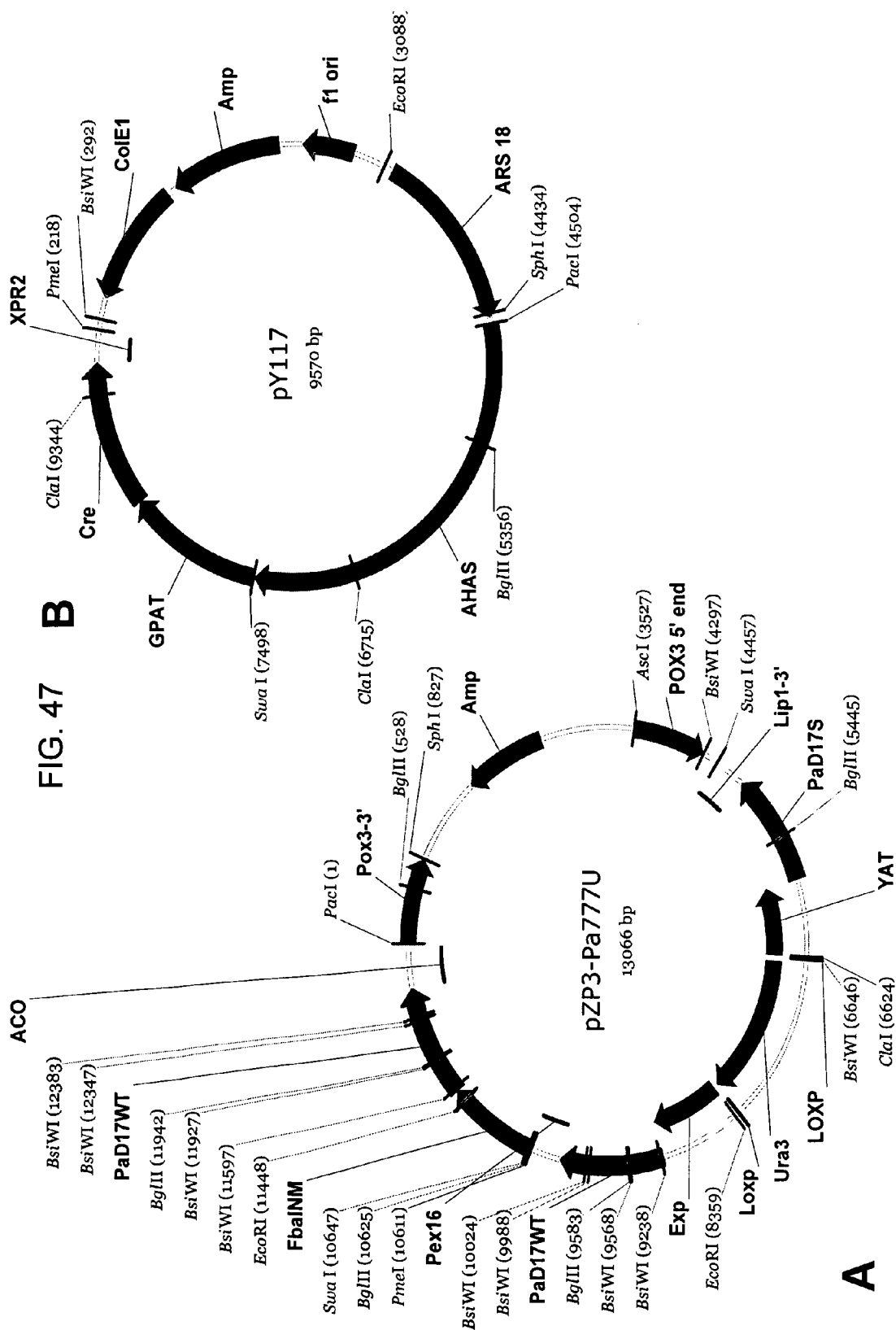

FIG. 47 provides plasmid maps for the following: (A) pZP3-Pa777U and (B) pY117.

Figure 48:
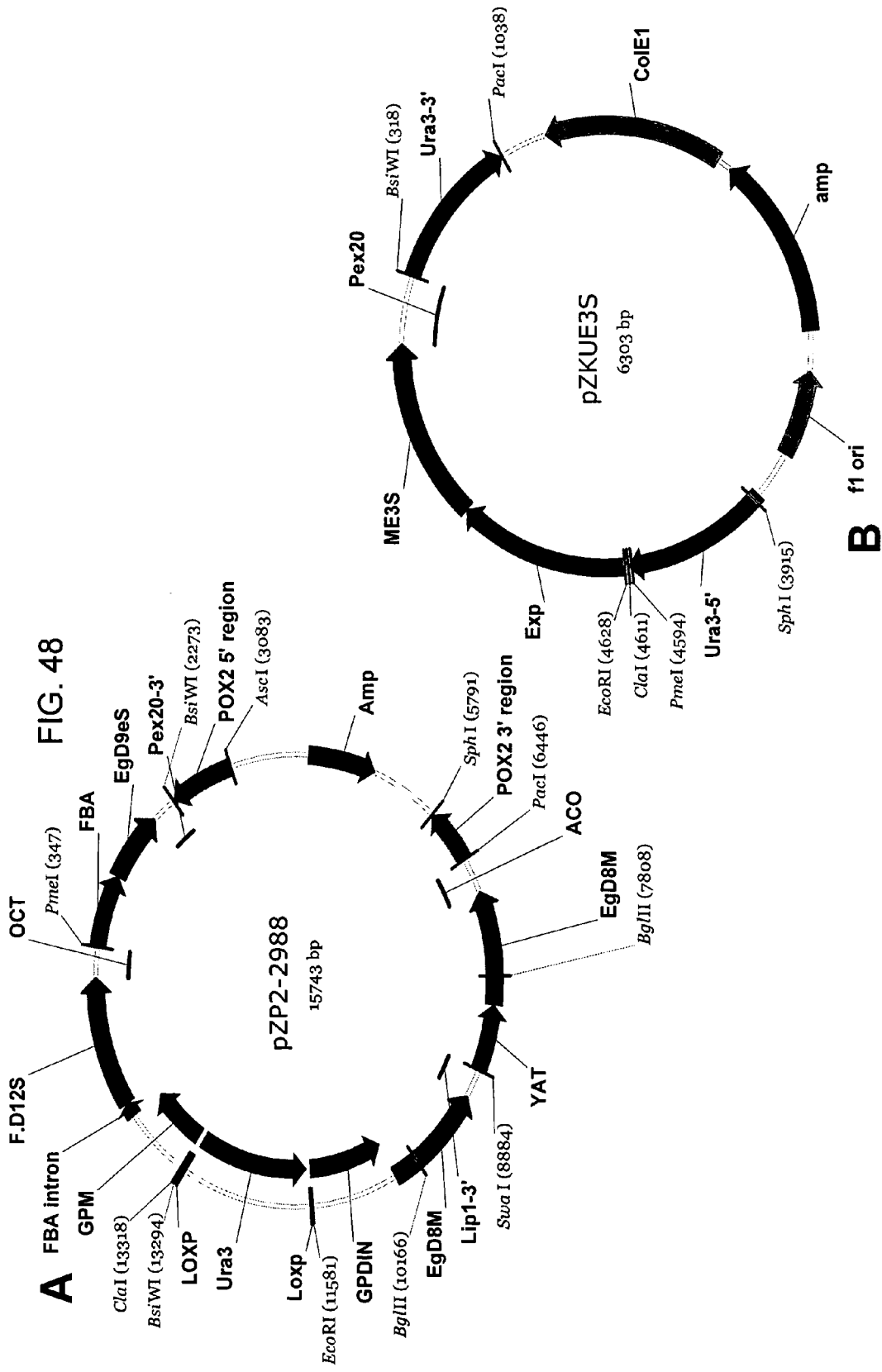

FIG. 48 provides plasmid maps for the following: (A) pZP2-2988 and (B) pZKUE3S.

Figure 49:
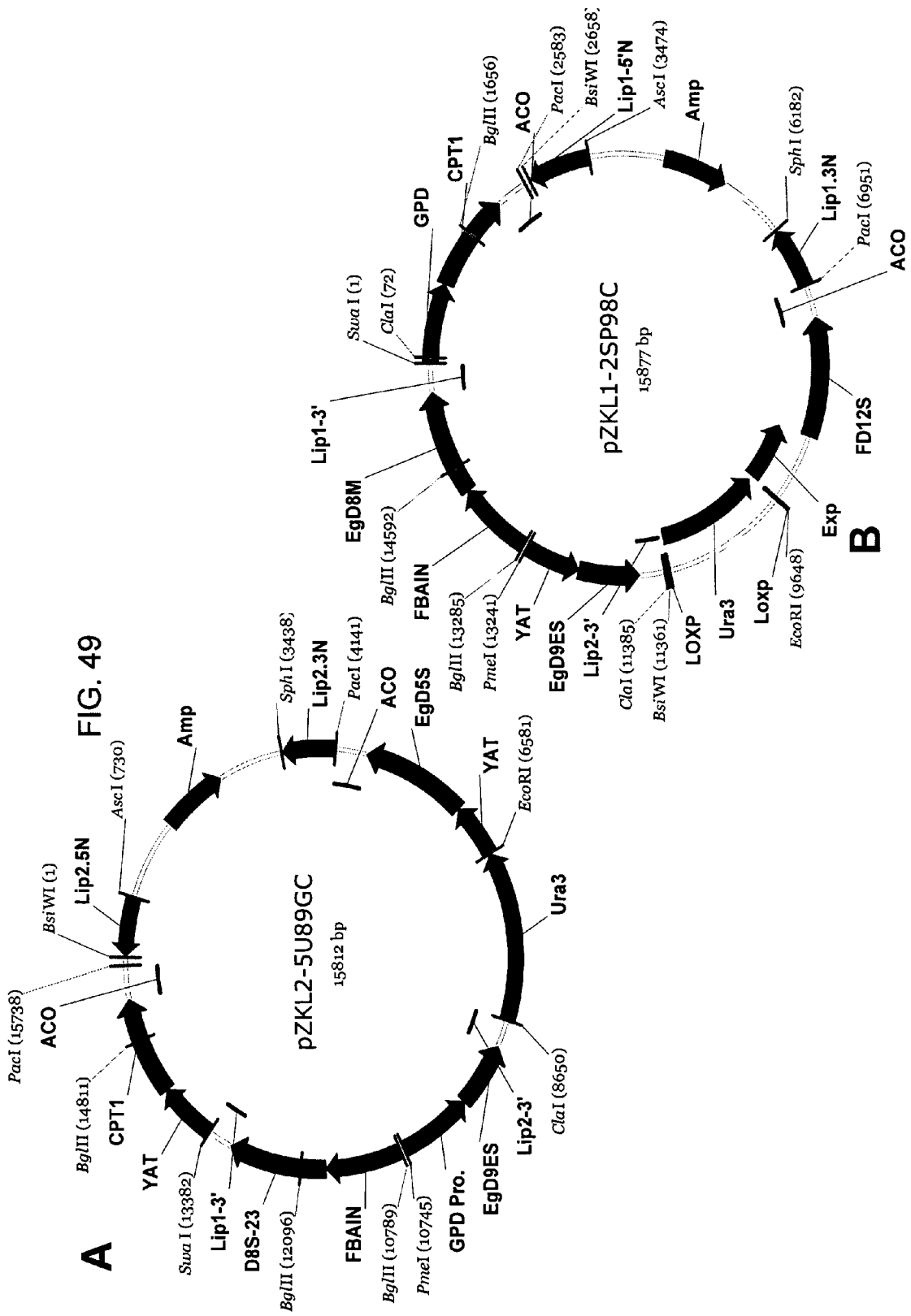

FIG. 49 provides plasmid maps for the following: (A) pZKL2-5U89GC and (B) pZKL1-2SP98C.

FIG. 50 provides plasmid maps for the following: (A) pZKUM and (B) pZKD2-5U89A2.

Figure 51:
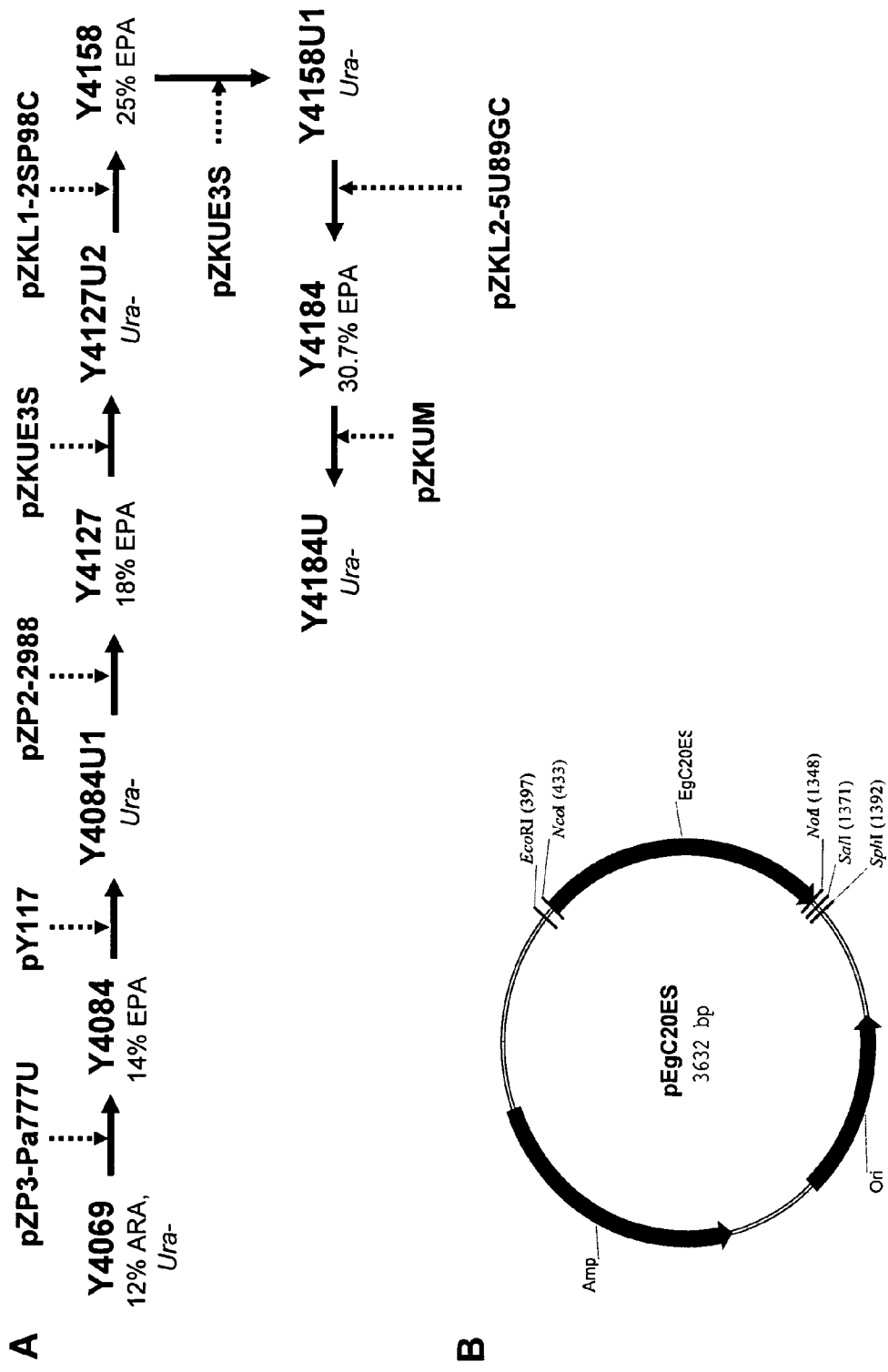

FIG. 51A diagrams the development of *Yarrowia lipolytica* strain Y4184U. FIG. 51B provides a plasmid map for pEgC20ES.

Figure 52:
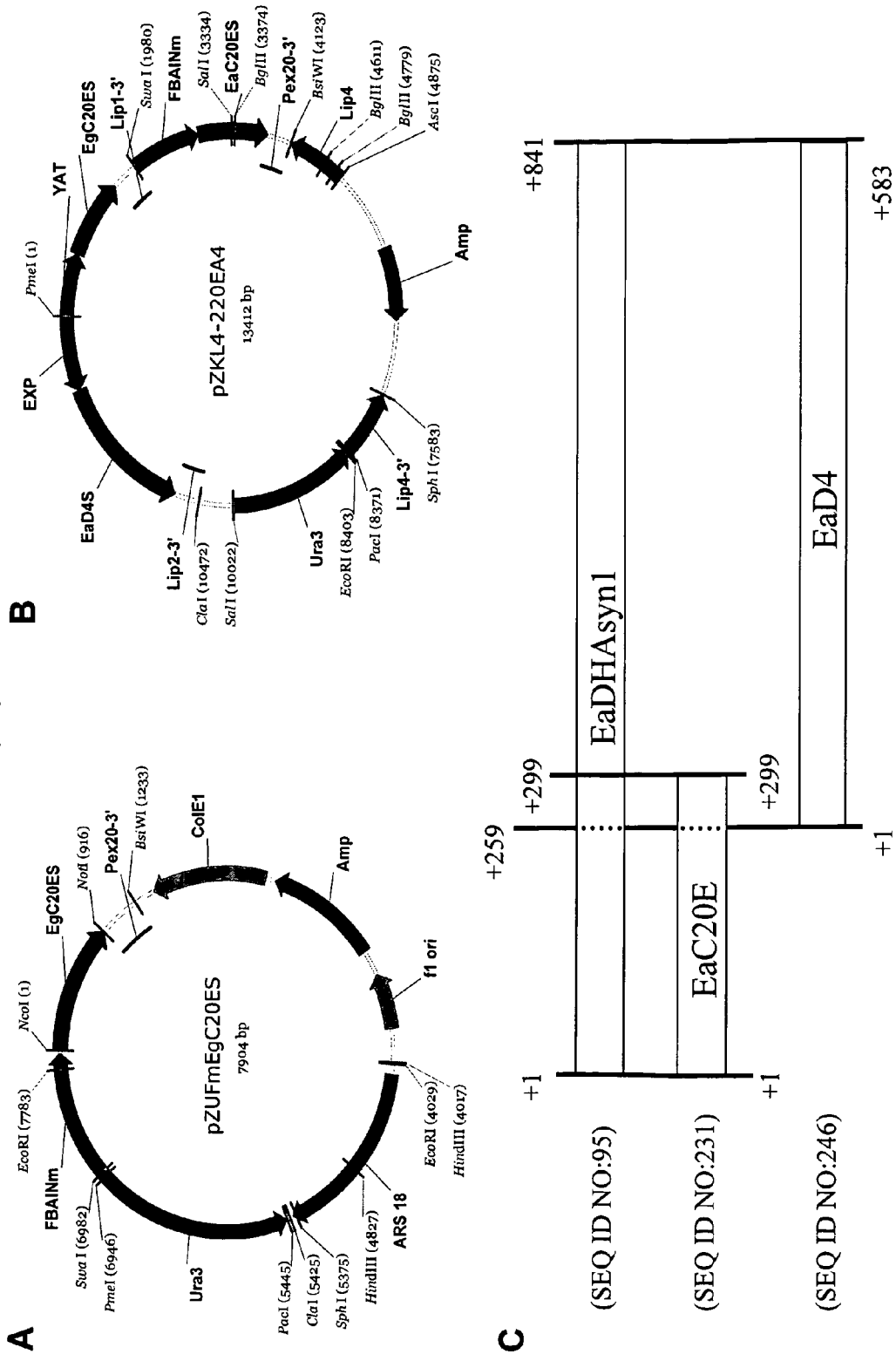

FIG. 52 provides plasmid maps for the following: (A) pZUFmEgC20ES and (B) pZKL4-220EA4. FIG. 52C is a schematic drawing showing overlap of the 3' region of the EaC20E domain (SEQ ID NO:231) with the 5' region of the EaD4 domain (SEQ ID NO:246) within EaDHAsyn1 (SEQ ID NO:95).

FIG. 53A shows an alignment between the N-termini of EaD4S (SEQ ID NO:193), EaD4S-1 (SEQ ID NO:382), EaD4S-2 (SEQ ID NO:384), and EaD4S-3 (SEQ ID NO:386). FIG. 53B shows an alignment between the N-termini of EgD4S (SEQ ID NO:388), EgD4S-1 (SEQ ID NO:404), EgD4S-2 (SEQ ID NO:406), and EgD4S-3 (SEQ ID NO:408).

Figure 54:
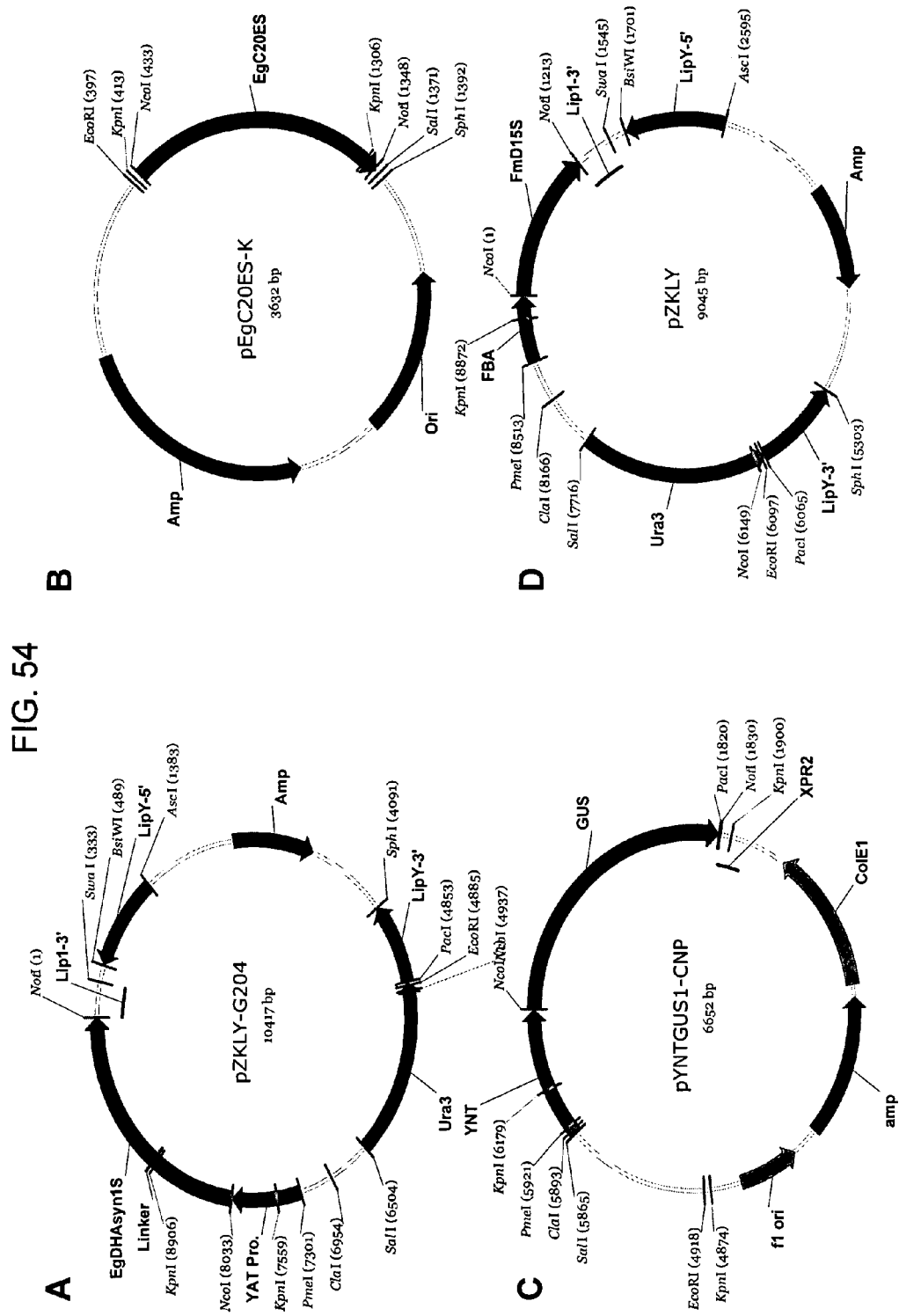

FIG. 54 provides plasmid maps for the following: (A) pZKLY-G204, (B) pEgC20ES-K, (C) pYNTGUS1-CNP, and (D) pZKLY.

Figure 55:
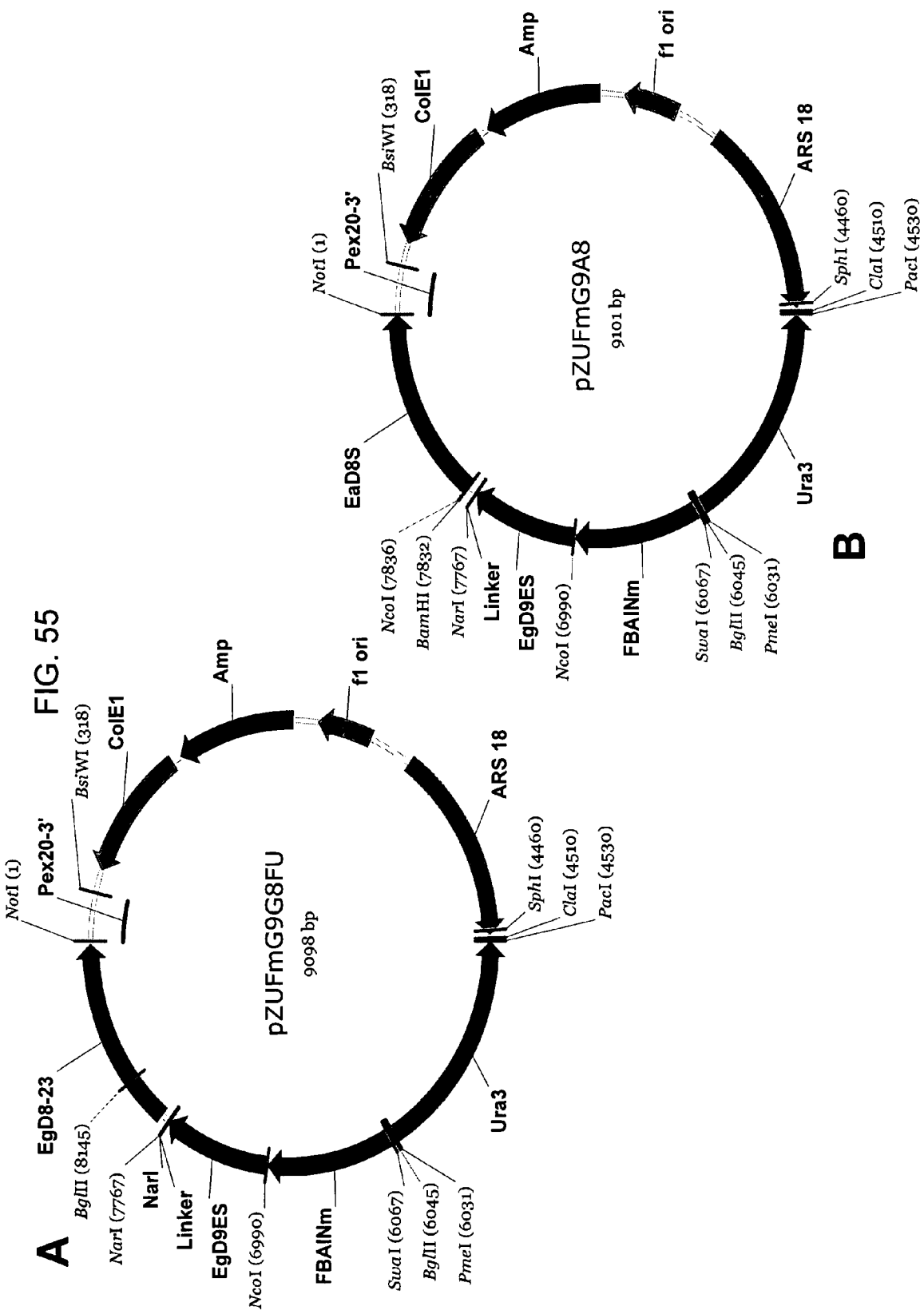

FIG. 55 provides plasmid maps for the following: (A) pZUFmG9G8fu and (B) pZUFmG9A8.

Figure 56:
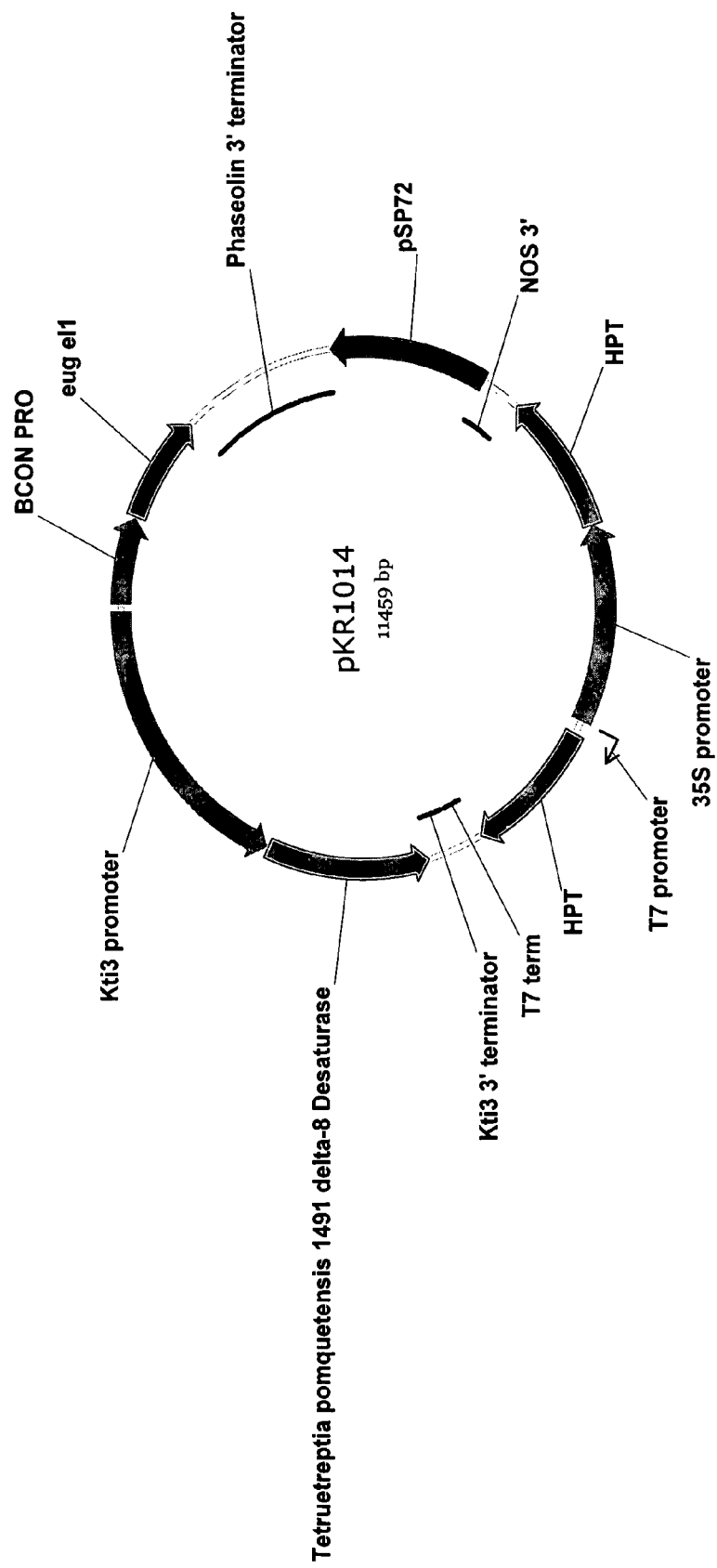
Figure 57:
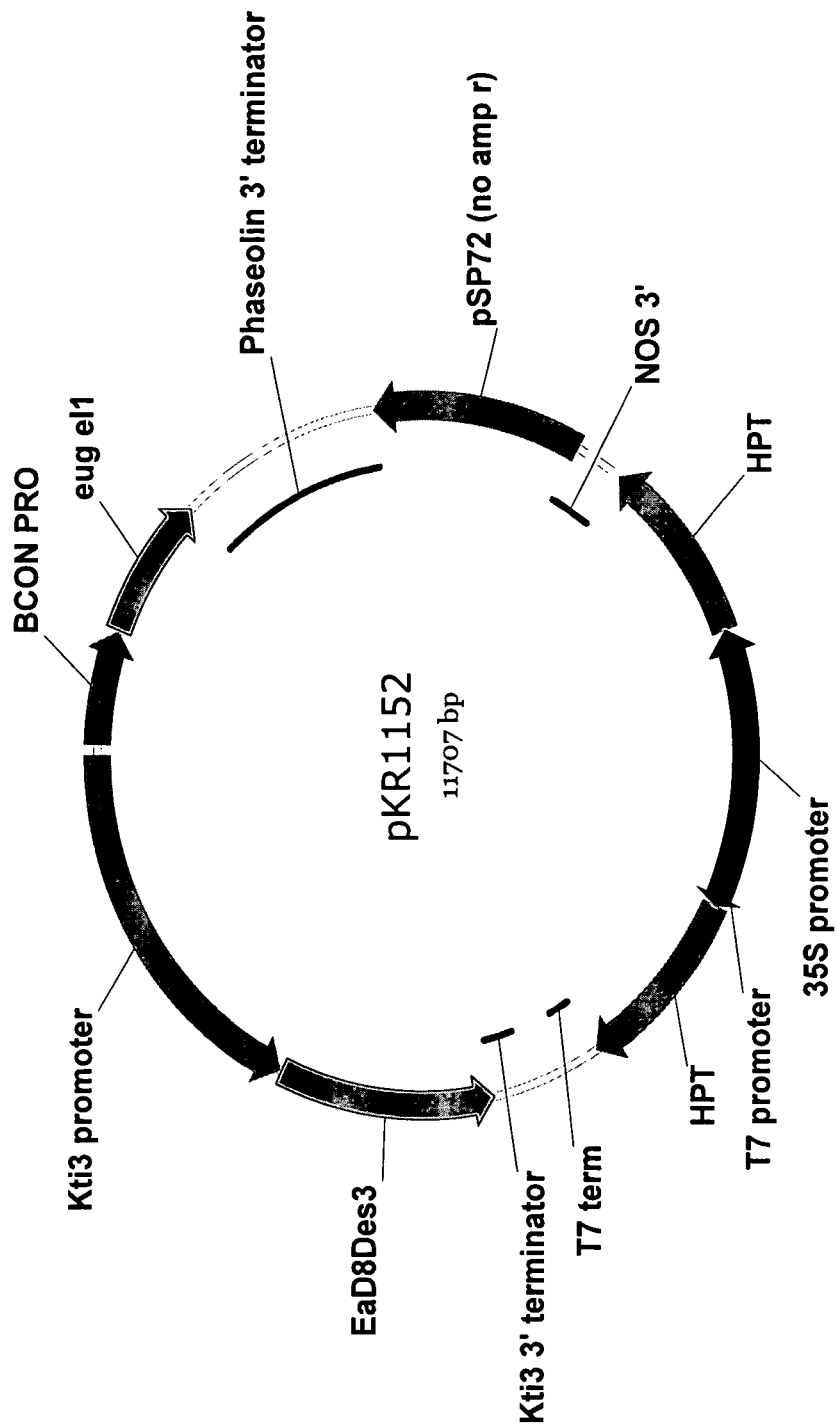
Figure 58:
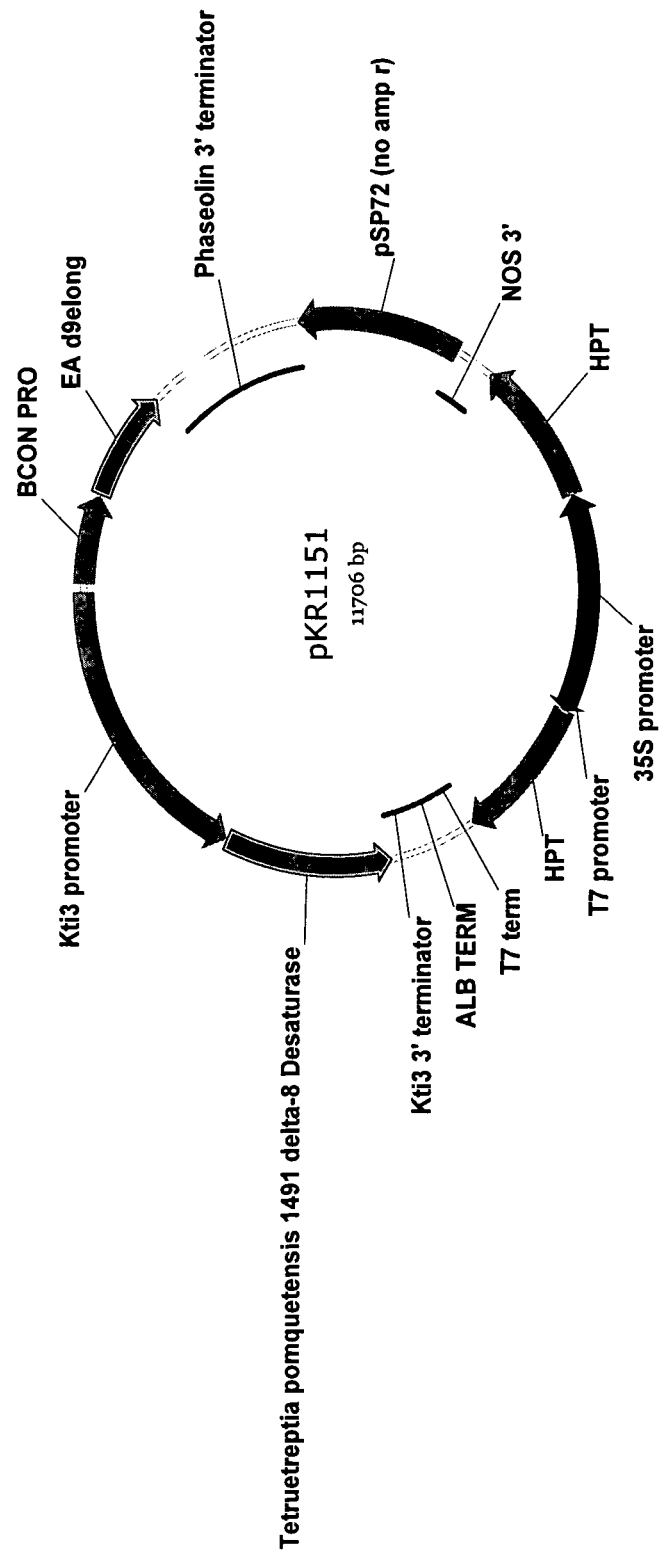
Figure 59:
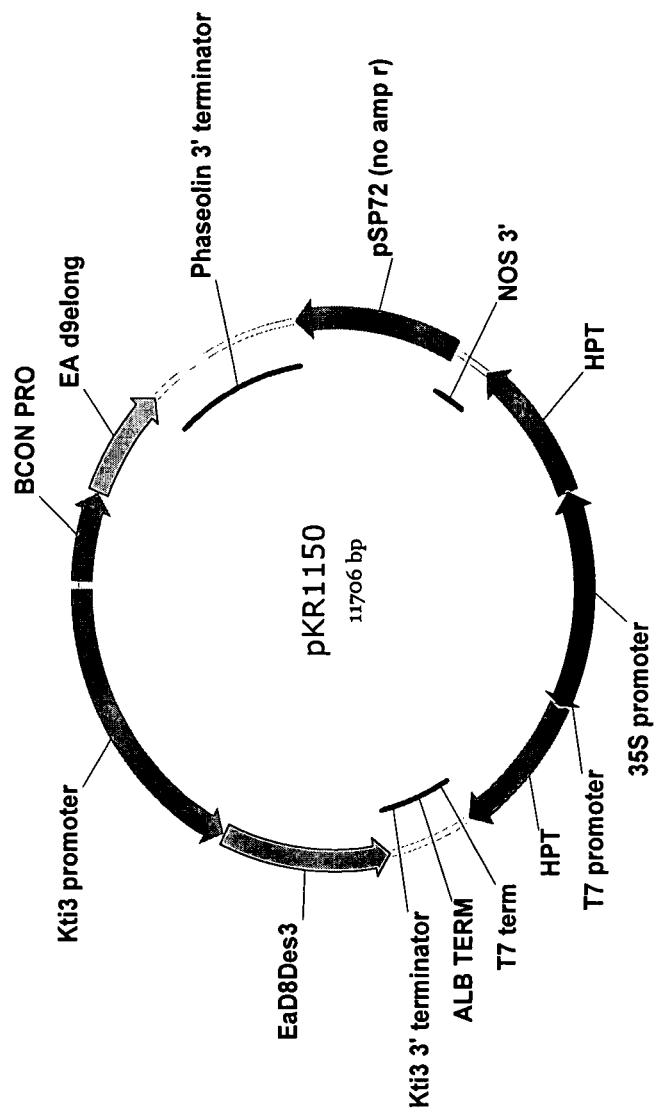
Figure 60:
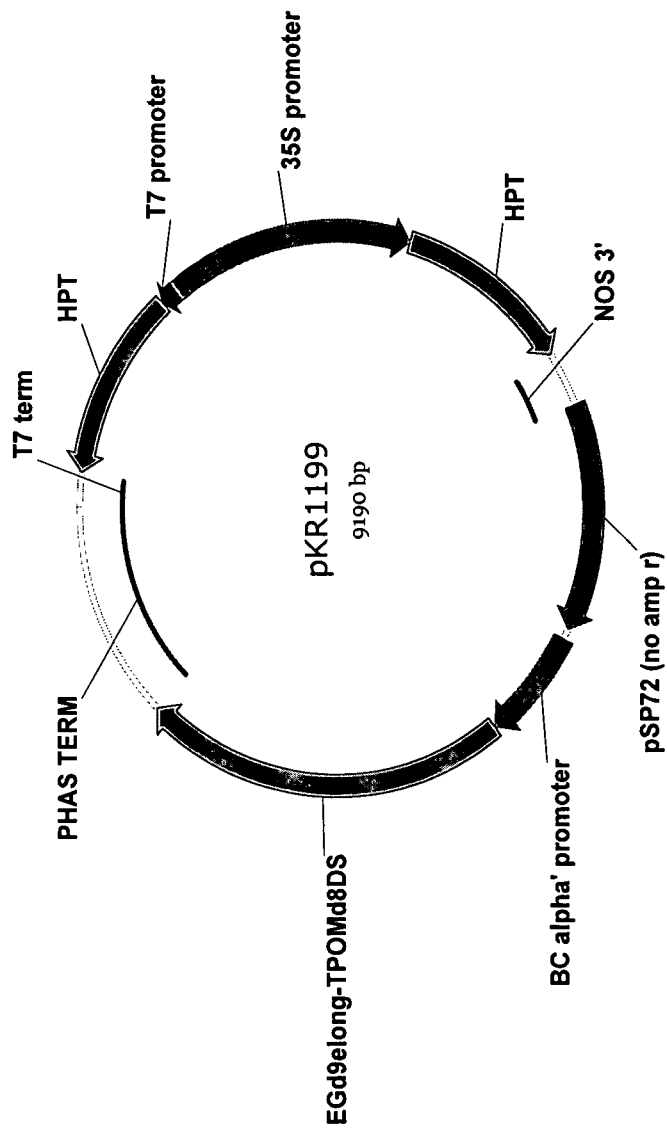
Figure 61:
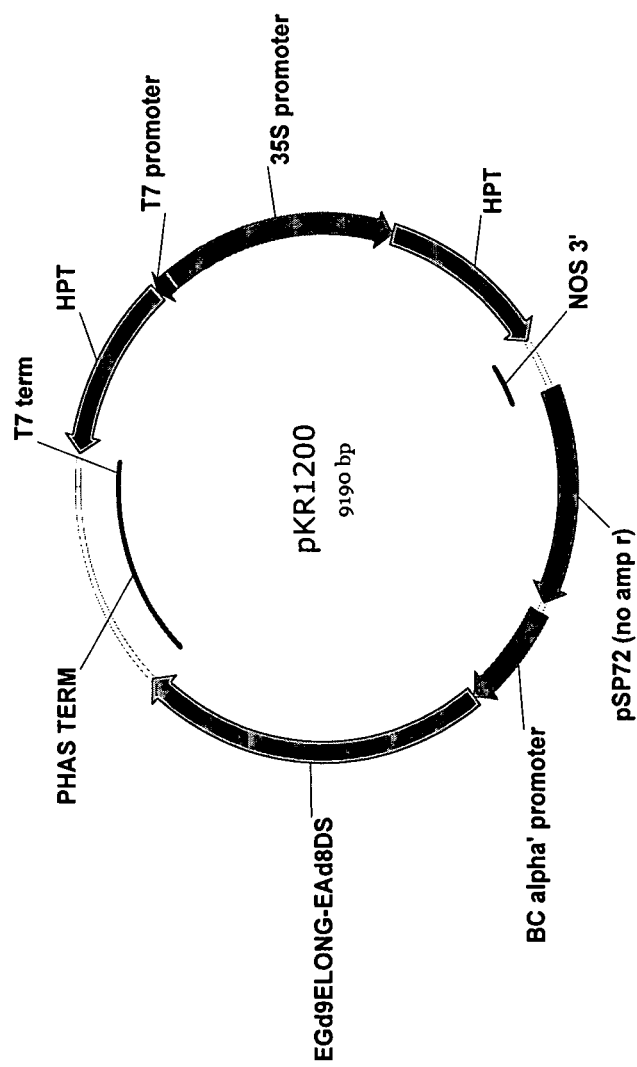
Figure 62:
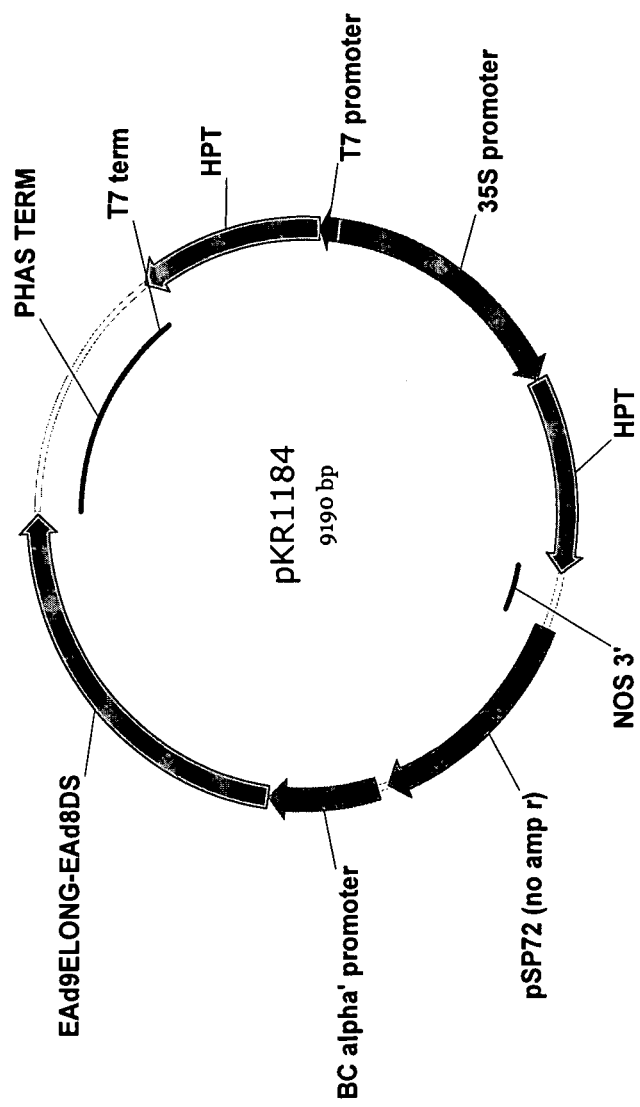
Figure 63:
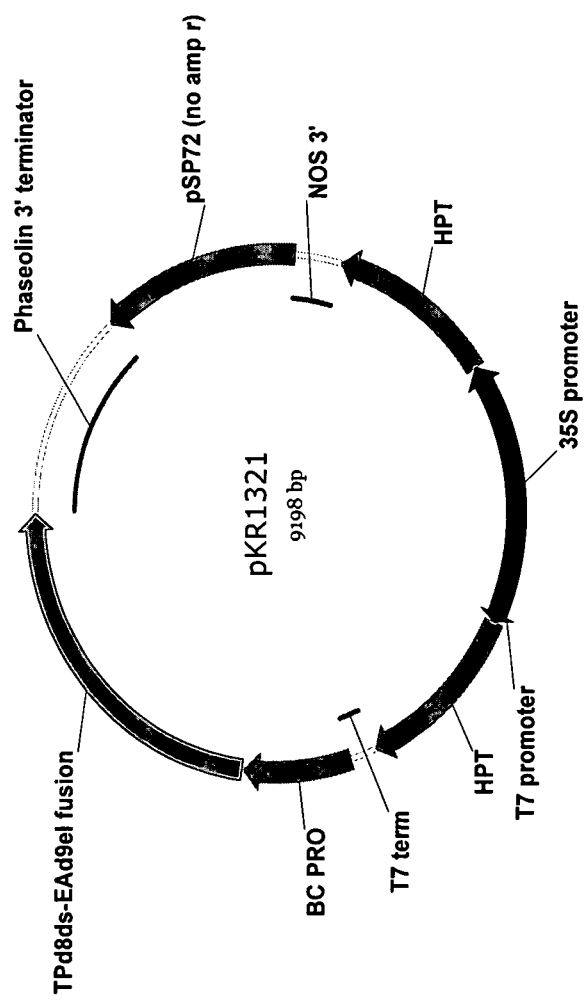
Figure 64:
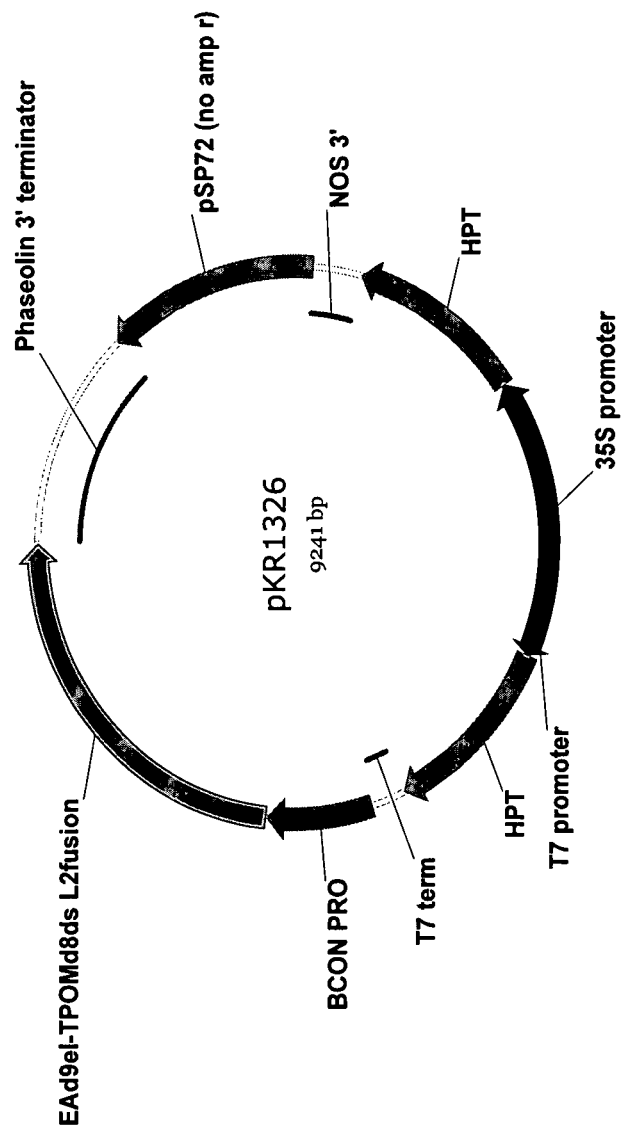

FIG. 56 is a map of pKR1014.
FIG. 57 is a map of pKR1152.
FIG. 58 is a map of pKR1151.
FIG. 59 is a map of pKR1150.
FIG. 60 is a map of pKR1199.
FIG. 61 is a map of pKR1200.
FIG. 62 is a map of pKR1184.
FIG. 63 is a map of pKR1321.
FIG. 64 is a map of pKR1326.

For FIGS. 65-71, fatty acids are identified as 16:0 (palmitate), 18:0 (stearic acid), 18:1 (oleic acid), LA, ALA, EDA, ERA, DGLA, and ETA, and fatty acid compositions are expressed as a weight percent (wt. %) of total fatty acids. In addition, elongation activity is expressed as % delta-9 elongation of C18 fatty acids (C18% delta-9 elong), calculated according to the following formula: ([product]/[substrate+product])*100. More specifically, the combined percent elongation for LA and ALA is determined as: ([DGLA+ETA+EDA+ERA]/[LA+ALA+DGLA+ETA+EDA+ERA])*100. The combined percent desaturation for EDA and ERA is shown as "C20% delta-8 desat", determined as: ([DGLA+ETA]/[DGLA+ETA+EDA+ERA])*100, and is also referred to as the overall % desaturation.

FIG. 65 shows the fatty acid profiles for the five events transformed with pKR1014 that have the highest average DGLA content (average of 5 soybean somatic embryos analyzed).

FIG. 66 shows the fatty acid profiles for the five events transformed with pKR1152 that have the highest average DGLA content (average of 5 soybean somatic embryos analyzed).

FIG. 67 shows the fatty acid profiles for the five events transformed with pKR1151 that have the highest average DGLA content (average of 5 soybean somatic embryos analyzed).

FIG. 68 shows the fatty acid profiles for the five events transformed with pKR1150 that have the highest average DGLA content (average of 5 soybean somatic embryos analyzed).

FIG. 69 shows the fatty acid profiles for the five events transformed with pKR1199 that have the highest average DGLA content (average of 5 soybean somatic embryos analyzed).

FIG. 70 shows the fatty acid profiles for the five events transformed with pKR1200 that have the highest average DGLA content (average of 5 soybean somatic embryos analyzed).

FIG. 71 shows the fatty acid profiles for the five events transformed with pKR1184 that have the highest average DGLA content (average of 5 soybean somatic embryos analyzed).

Figure 72:
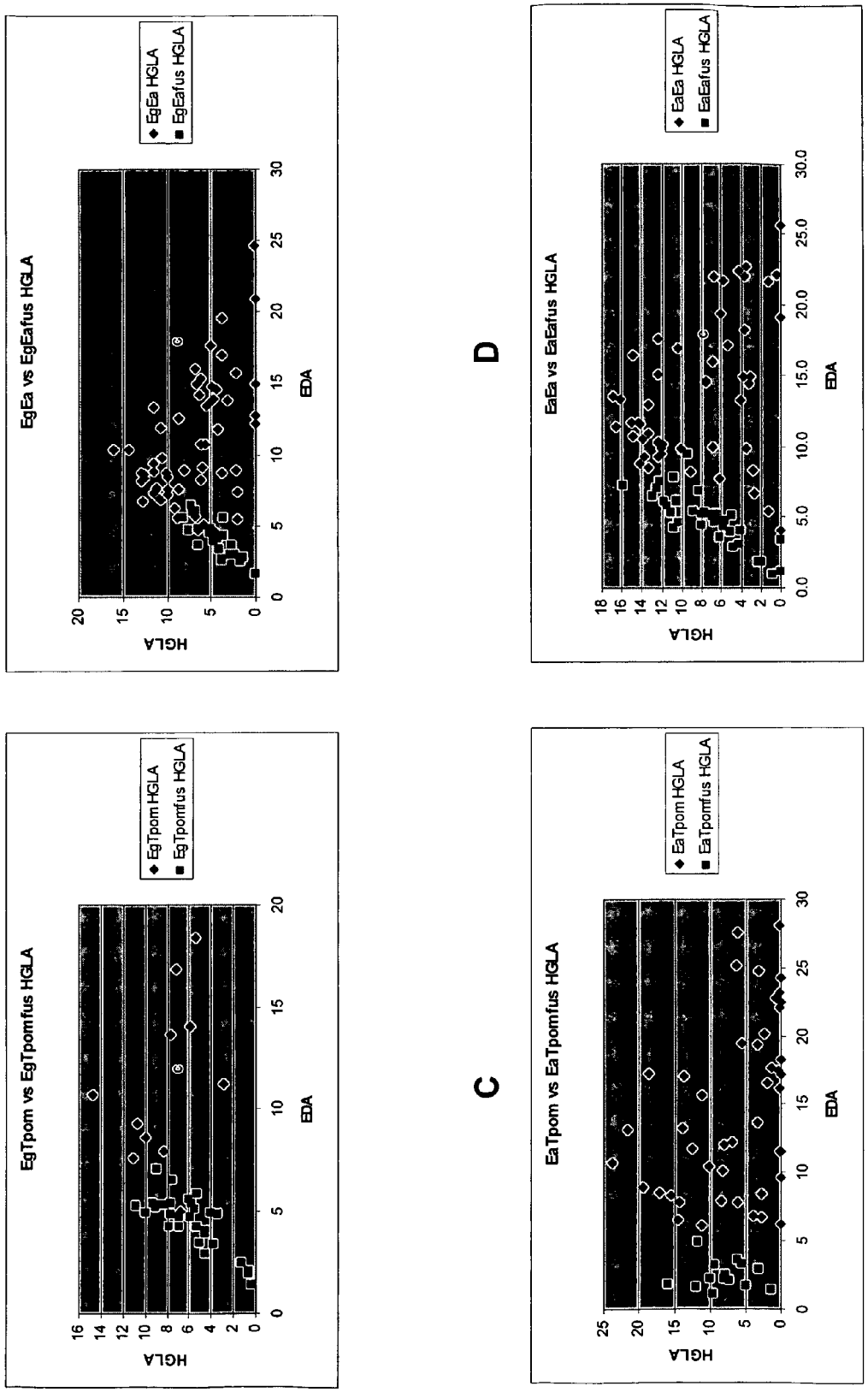

FIG. 72 shows a comparison of individually expressed delta-9 elongases with delta-8 desaturases versus the equivalent delta-9 elongase-delta-8 desaturase fusion. Each data point represents the average % DGLA or % EDA for 5-6 embryos (as a % of total fatty acids) for all events analyzed, and Avg. % DGLA is plotted vs. Avg. % EDA. In (A), EgTpom represents EgD9e co-expressed with TpomD8 (pKR1014), and EgTpomfus represents the EgD9e/TpomD8 fusion (pKR1199). In (B), EgEa represents EgD9e co-expressed with EaD8 (pKR1152), and EgEafus represents the EgD9e/EaD8 fusion (pKR1200). In (C), EaTpom represents EaD9e co-expressed with TpomD8 (pKR1151), and EaTpomfus represents the EaD9e/TpomD8 fusion (pKR1183). In FIG. (D), EaEa represents EaD9e co-expressed with EaD8 (pKR1150) and EaEafus represents the EaD9e/EaD8 fusion (pKR1200).

FIG. 73 shows the fatty acid profiles for the five events transformed with pKR1322 (Experiment MSE2274) that have the highest average ARA and EPA content (average of the 5 embryos analyzed) Fatty acids are identified as 16:0 (palmitate), 18:0 (stearic acid), 18:1 (oleic acid), 18:2 (5,9), LA, ALA, EDA, ERA, SCI, DGLA, JUN (also called JUP), ETA, ARA and EPA. Fatty acid compositions are expressed as a weight percent (wt. %) of total fatty acids. Elongation activity is expressed as % delta-9 elongation of C18 fatty acids (% Elo), calculated according to the following formula: ([product]/[substrate+product])*100. More specifically, the combined percent elongation for LA and ALA is determined as: ([DGLA+ETA+EDA+ERA+EPA+ARA]/[LA+ALA+DGLA+ETA+EDA+ERA+EPA+ARA])*100. The combined percent delta-8 desaturation for EDA and ERA is shown as "% D8", determined as: ([DGLA+ETA+EPA+ARA]/[DGLA+ETA+EDA+ERA+EPA+ARA])*100. This is also referred to as the overall % delta-8 desaturation. The combined percent delta-5 desaturation for DGLA and ETA is shown as "% D5", determined as: ([EPA+ARA]/[DGLA+ETA+EPA+ARA])*100. This is also referred to as the overall % delta-5 desaturation.

FIG. 74 shows the fatty acid profiles for the five events transformed with pKR1326 (Experiment MSE2275) that have the highest average DGLA and ETA content (average of the 5 embryos analyzed). Fatty acids are identified as 16:0 (palmitate), 18:0 (stearic acid), 18:1 (oleic acid), LA, ALA, EDA, ERA, DGLA and DGLA and ETA. Fatty acid compositions are expressed as a weight percent (wt. %) of total fatty acids. Elongation activity is expressed as % delta-9 elongation of C18 fatty acids (C18% delta-9 elong), calculated according to the following formula: ([product]/[substrate+product])*100. More specifically, the combined percent elongation for LA and ALA is determined as: ([DGLA+ETA+EDA+ERA]/[LA+ALA+DGLA+ETA+EDA+ERA])*100. The combined percent desaturation for EDA and ERA is shown as "C20% delta-8 desat", determined as: ([DGLA+ETA]/[DGLA+ETA+EDA+ERA])*100. This is also referred to as the overall % desaturation.

The sequence descriptions summarize the Sequences Listing attached hereto. The Sequence Listing contains one letter codes for nucleotide sequence characters and the single and three letter codes for amino acids as defined in the IUPAC-IUB standards described in *Nucleic Acids Research* 13:3021-3030 (1985) and in the *Biochemical Journal* 219(2):345-373 (1984).

SEQ ID NOs:1-519 are primers, ORFs encoding genes, proteins (or portions thereof), or plasmids, as identified in Table 2.

TABLE 2

Summary Of Nucleic Acid And Protein SEQ ID Numbers

| Description and Abbreviation | Nucleic acid SEQ ID NO. | Protein SEQ ID NO. |
|---|---|---|
| M13F universal primer | 1 | — |
| *Pavlova* sp. CCMP459 C20-polyunsaturated fatty acid elongase (GenBank Accession No. AAV33630) | — | 2 (277 AA) |
| *Euglena gracilis* clone eeg1c.pk005.p14.f 5' sequence | 3 (608 bp) | — |
| *Euglena gracilis* clone eeg1c.pk005.p14.f full insert sequence | 4 (1327 bp) | — |
| *Euglena gracilis* clone eeg1c.pk005.p14.f coding sequence ("EgC20elo1") | 5 (897 bp) | 6 (298 AA) |
| Primer SeqE | 7 | — |
| Primer SeqW | 8 | — |
| *Euglena gracilis* clone eeg1c.pk016.e6.f 5' sequence | 9 (742 bp) | — |
| *Euglena gracilis* clone eeg1c.pk016.e6.f full insert sequence | 10 (2630 bp) | — |
| *Euglena gracilis* clone eeg1c.pk016.e6.f coding sequence (DHA synthase 1 or "EgDHAsyn1") | 11 (2382 bp) | 12 (793 AA) |
| *Euglena gracilis* delta-4 fatty acid desaturase (GenBank Accession No. AAQ19605) | — | 13 (541 AA) |
| M13rev primer | 14 | — |
| EUGel4-1 primer | 15 | — |
| EgEloD4Mut-5 primer | 16 | — |
| oEUGel4-2 primer | 17 | — |
| EgDHAsyn5' primer | 18 | — |
| EgDHAsyn3' primer | 19 | — |
| *Euglena gracilis* clone eeg1c-1 full insert sequence | 20 (2630 bp) | — |
| *Euglena gracilis* clone eeg1c-1 coding sequence (DHA synthase 2 or "EgDHAsyn2") | 21 (2382 bp) | 22 (793 AA) |
| *Euglena gracilis* delta-4 desaturase cDNA sequence (GenBank Accession No. AY278558) | 23 (2569 bp) | — |
| *Euglena gracilis* delta-4 desaturase-coding sequence (GenBank Accession No. AY278558) | 24 (1626 bp) | — |
| *Ostreococcus tauri* PUFA elongase 2 (GenBank Accession No. AAV67798) | — | 25 (300 AA) |
| *Thalassiosira pseudonana* PUFA elongase 2 (GenBank Accession No. AAV67800) | — | 26 (358 AA) |
| *Thraustochytrium aureum* delta-4 desaturase (GenBank Accession No. AAN75707) | — | 27 (515 AA) |
| *Schizochytrium aggregatum* delta-4 desaturase (PCT Publication No. WO 2002/090493) | — | 28 (509 AA) |

TABLE 2-continued

Summary Of Nucleic Acid And Protein SEQ ID Numbers

| Description and Abbreviation | Nucleic acid SEQ ID NO. | Protein SEQ ID NO. |
|---|---|---|
| *Thalassiosira pseuduonana* delta-4 fatty acid desaturase (GenBank Accession No. AAX14506) | — | 29 (550 AA) |
| *Isochrysis galbana* delta-4 desaturase (GenBank Accession No. AAV33631) | — | 30 (433 AA) |
| Plasmid pDMW263 | 31 (9472 bp) | — |
| Plasmid pDMW237 | 32 (7879 bp) | — |
| Plasmid pY115 | 33 (7783 bp) | — |
| Plasmid pBY1 | 34 (8704 bp) | — |
| oYFBA1 primer | 35 | — |
| oYFBA1-6 primer | 36 | — |
| Plasmid pY158 | 37 (6992 bp) | — |
| Plasmid pY159 | 38 (8707 bp) | — |
| Plasmid pBY-C20elo1 | 39 (8425 bp) | — |
| Plasmid pY132 | 40 (9677 bp) | — |
| Plasmid pY161 | 41 (9680 bp) | — |
| Plasmid pY164 | 42 (9701 bp) | — |
| EgEPAEloDom-5 primer | 43 | — |
| oEUG el4-3 primer | 44 | — |
| Plasmid pKR1062 | 45 (5914 bp) | — |
| EgEloD4Mut-5 primer | 46 | — |
| EgEloD4Mut-3 primer | 47 | — |
| Plasmid pLF115-7 | 48 (5914 bp) | — |
| Plasmid pY141 | 49 (9373 bp) | — |
| EgDPAEloDom-3 primer | 50 | — |
| Plasmid pHD16 | 51 (4443 bp) | — |
| Plasmid pY143 | 52 (7903 bp) | — |
| oEUGsyn6-2 primer | 53 | — |
| Plasmid pKR1071 | 54 (4497 bp) | — |
| Plasmid pY149 | 55 (8005 bp) | — |
| oEUGsyn6-3 primer | 56 | — |
| Plasmid pKR1091 | 57 (4498 bp) | — |
| Plasmid pY155 | 58 (8006 bp) | — |
| oRIG6-1 primer | 59 | — |
| oRIG6-2 primer | 60 | — |
| Plasmid pKR1067 | 61 (4827 bp) | — |
| Plasmid pY150 | 62 (8293 bp) | — |
| Plasmid pKR1097 | 63 (5795 bp) | — |
| Plasmid pY156 | 64 (9253 bp) | — |
| oEGslne6-1 primer | 65 | — |
| Plasmid pKR1069 | 66 (4947 bp) | — |
| Plasmid pY152 | 67 (8413 bp) | — |
| Plasmid pKR1099 | 68 (5915 bp) | — |
| Plasmid pY157 | 69 (9373 bp) | — |
| oEUGel4-4 primer | 70 | — |
| Plasmid pKR1073 | 71 (5151 bp) | — |
| Plasmid pY153 | 72 (8617 bp) | — |
| oRSA1-1 primer | 73 | — |
| oRSA1-2 primer | 74 | — |
| Plasmid pKR1068 | 75 (5058 bp) | — |
| Plasmid pY151 | 76 (8524 bp) | — |
| Plasmid pY160 | 77 (9484 bp) | — |
| EaDHAsyn5' primer | 78 | — |
| EaDHAsyn5'2 primer | 79 | — |
| EaDHAsyn5'3 primer | 80 | — |
| EaDHAsyn5'4 primer | 81 | — |
| EaDHAsyn3' primer | 82 | — |
| EaDHAsyn3'2 primer | 83 | — |
| EaDHAsyn3'3 primer | 84 | — |
| EaDHAsyn3'4 primer | 85 | — |
| EaDHAsyn3'5 primer | 86 | — |
| Plasmid pLF117-1 | 87 (5582 bp) | — |
| Plasmid pLF117-2 | 88 (5607 bp) | — |
| Plasmid pLF117-3 | 89 (5608 bp) | — |
| Plasmid pLF117-4 | 90 (5557 bp) | — |
| *Euglena anabaena* coding sequence (DHA synthase 1 or "EaDHAsyn1") | 91 (2523 bp) | 95 (841 AA) |
| *Euglena anabaena* coding sequence (DHA synthase 2 or "EaDHAsyn2") | 92 (2523 bp) | 96 (841 AA) |
| *Euglena anabaena* coding sequence (DHA synthase 3 or "EaDHAsyn3") | 93 (2523 bp) | 97 (841 AA) |
| *Euglena anabaena* coding sequence (DHA synthase 4 or "EaDHAsyn4") | 94 (2442 bp) | 98 (814 AA) |
| Plasmid pY165 | 99 (10,133 bp) | — |
| Plasmid pY166 | 100 (10,158 bp) | — |

TABLE 2-continued

Summary Of Nucleic Acid And Protein SEQ ID Numbers

| Description and Abbreviation | Nucleic acid SEQ ID NO. | Protein SEQ ID NO. |
|---|---|---|
| Plasmid pY167 | 101 (10,159 bp) | — |
| Plasmid pY168 | 102 (10,108 bp) | — |
| oEGel2-1 primer | 103 | — |
| Plasmid pKR1055 | 104 (5916 bp) | — |
| Plasmid pKR72 | 105 (7085 bp) | — |
| oCon-1 primer | 106 | — |
| oCon-2 primer | 107 | — |
| Plasmid pKR179 | 108 (4480 bp) | — |
| Plasmid pKR1057 | 109 (6873 bp) | — |
| Plasmid pKR328 | 110 (8671 bp) | — |
| Plasmid pKR1061 | 111 (12,844 bp) | — |
| *Euglena gracilis* delta-9 elongase ("EgD9elo" or "EgD9e" or EgD9E") | 112 (777 bp) | 513 (258 AA) |
| oEugEL1-1 primer | 113 | — |
| oEugEL1-2 primer | 114 | — |
| Plasmid pKR906 | 115 (4311 bp) | — |
| Plasmid pKR132 | 116 (3983 bp) | — |
| Plasmid pKR953 | 117 (4771 bp) | — |
| Plasmid pKR287 | 118 (5492 bp) | — |
| *Mortierella alpina* delta-5 desaturase ("MaD5") | 119 (1338 bp) | — |
| Plasmid pKR277 | 120 (2577 bp) | — |
| Plasmid pKR952 | 121 (5364 bp) | — |
| Plasmid pKR457 | 122 (5252 bp) | — |
| Modified Kti/NotI/Kti3'Salb3' cassette | 123 (2635 bp) | — |
| *Pavlova lutheri* delta-8 desaturase ("PavD8") | 124 (1269 bp) | — |
| PvDES5'Not-1 primer | 125 | — |
| PvDES3'Not-1 primer | 126 | — |
| Plasmid pKR970 | 127 (9276 bp) | — |
| Plasmid pKR973 | 128 (11,366 bp) | — |
| Plasmid pKR271 | 129 (6021 bp) | — |
| Plasmid pKR226 | 130 (6524 bp) | — |
| Plasmid pKR886r | 131 (9892 bp) | — |
| Plasmid pKR1064 | 132 (14,066 bp) | — |
| Plasmid pZBL119 | 133 (8503 bp) | — |
| oSGly-2 primer | 134 | — |
| oSGly-3 primer | 135 | — |
| Plasmid pPSgly32 | 136 (3673 bp) | — |
| Plasmid pKR142 | 137 (4509 bp) | — |
| Plasmid pKR264 | 138 (4171 bp) | — |
| Plasmid pKR1128 | 139 (6564 bp) | — |
| Plasmid pKS129 | 140 (5671 bp) | — |
| Plasmid pKR606 | 141 (6601 bp) | — |
| Plasmid pKR804 | 142 (6494 bp) | — |
| Plasmid pKR1130 | 143 (10,349 bp) | — |
| Plasmid pKR1131 | 144 (4771 bp) | — |
| Plasmid pKR1133 | 145 (12,430 bp) | — |
| Plasmid pKS123 | 146 (7048 bp) | — |
| oKti5 primer | 147 | — |
| oKti6 primer | 148 | — |
| Plasmid pKR124 | 149 (4990 bp) | — |
| Plasmid pKR193 | 150 (4474 bp) | — |
| Plasmid pKR1103 | 151 (5397 bp) | — |
| Plasmid pKR1104 | 152 (9226 bp) | — |
| Plasmid pKR300 | 153 (8649 bp) | — |
| *Schizochytrium aggregatum* delta-4 desaturase* (internal AscI site removed) | 154 (1607 bp) | — |
| Plasmid pKR1102 | 155 (6851 bp) | — |
| Plasmid pKR1105 | 156 (13,424 bp) | — |
| oEUGsyn6-4 primer | 157 | — |
| Plasmid pKR1107 | 158 (4498 bp) | — |
| Plasmid pKR1112 | 159 (4461 bp) | — |
| Plasmid pKR1115 | 160 (5989 bp) | — |
| Plasmid pKR1134 | 161 (10,807 bp) | — |
| *Tetruetreptia pomquetensis* CCMP1491 delta-8 desaturase ("TpomD8") | 162 (1260 bp) | 514 (420 AA) |
| TpomNot-5 primer | 163 | — |
| TpomNot-3 primer | 164 | — |
| Plasmid pLF114-10 | 165 (4300 bp) | — |
| Plasmid pKR1002 | 166 (5754 bp) | — |
| Plasmid pKR1095 | 167 (11,725 bp) | — |
| Plasmid pKR1127 | 168 (5445 bp) | — |
| Plasmid pKR1129 | 169 (9230 bp) | — |
| Plasmid pKR1132 | 170 (11,311 bp) | — |
| *Euglena gracilis* DHAsynthase 1 linker | 171 (54 bp) | — |

TABLE 2-continued

Summary Of Nucleic Acid And Protein SEQ ID Numbers

| Description and Abbreviation | Nucleic acid SEQ ID NO. | Protein SEQ ID NO. |
|---|---|---|
| MWG507 primer | 172 | — |
| MWG509 primer | 173 | — |
| MWG510 primer | 174 | — |
| MWG511 primer | 175 | — |
| EgD9elo-EgDHAsyn1Link | 176 (839 bp) | — |
| Plasmid KS366 | 177 (5213 bp) | — |
| KS366-EgD9elo-EgDHAsyn1Link | 178 (5559 bp) | — |
| Plasmid KS373 | 179 (6842 bp) | — |
| Conserved motif at C-terminal for C20 elongase domains | — | 180 (11 AA) |
| SMART IV primer | 181 | — |
| Adaptor Primer from the Invitrogen 3'-RACE kit | 182 | — |
| Synthetic C20 elongase derived from *Euglena gracilis*, codon-optimized for expression in *Yarrowia lipolytica* ("EgC20ES") | 183 (912 bp) | 184 (303 AA) |
| Plasmid pEgC20ES | 185 (3632 bp) | — |
| NG motif located at the C-terminus of each of the C20 elongase domains of EgDHAsyn1, EgDHAsyn2 and EgC20elo1 | — | 186 |
| PENGA motif located at the C-terminus of each of the C20 elongase domains of EgDHAsyn1, EgDHAsyn2 and EgC20elo1 | — | 187 |
| Synthetic C20 elongase derived from *Euglena anabaena*, codon-optimized for expression in *Yarrowia lipolytica* ("EaC20ES") | 188 (900 bp) | 189 (299 AA) |
| Plasmid pEaC20ES | 190 (3620 bp) | — |
| PCENGTV motif located at the C-terminus of each of the C20 elongase domains of EgDHAsyn1, EgDHAsyn2 and EgC20elo1 | — | 191 |
| Synthetic delta-4 desaturase derived from *Euglena anabaena*, codon-optimized for expression in *Yarrowia lipolytica* ("EaD4S") | 192 (1752 bp) | 193 (583 AA) |
| Delta-4 desaturase gene domain of EaDHAsyn2 (i.e., corresponding to amino acids 259-841 of SEQ ID NO: 96) | 194 (1749 bp) | 195 (583 AA) |
| Plasmid pEaD4S | 196 (4472 bp) | — |
| *Euglena gracilis* EgDHAsyn1 proline-rich linker | 197 (54 bp) | 198 (18 AA) |
| *Euglena gracilis* EgDHAsyn2 proline-rich linker | 199 (54 bp) | 200 (18 AA) |
| *Euglena gracilis* EgDHAsyn1 C20 elongase domain | 201 (909 bp) | 202 (303 AA) |
| *Euglena gracilis* EgDHAsyn2 C20 elongase domain | 203 (909 bp) | 204 (303 AA) |
| *Euglena gracilis* EgDHAsyn1* (internal NcoI site removed) | 205 (2379 bp) | — |
| *Euglena gracilis* EgDHAsyn1* C20 elongase domain ("EgDHAsyn1C20EloDom1") | 206 (909 bp) | — |
| *Euglena gracilis* EgDHAsyn1* C20 elongase domain-proline-rich linker fusion gene ("EgDHAsyn1C20EloDom2Linker") | 207 (975 bp) | 208 (325 AA) |
| *Isochrysis galbana* delta-4 desaturase ("IgD4") | 209 (1299 bp) | — |
| *Isochrysis galbana* delta-4 desaturase ("IgD4*") (internal SbfI site introduced) | 210 (1299 bp) | 211 (433 AA) |
| In-frame fusion between EgDHAsyn1C20EloDom3Linker and IgD4*, separated by proline-rich linker region ("EgDHAsyn1C20EloDom3-IgD4*") | 212 (2259 bp) | 213 (753 AA) |
| *Euglena gracilis* EgDHAsyn1D4Dom1 | 214 (1416 bp) | 215 (472 AA) |
| *Euglena gracilis* EgDHAsyn1D4Dom1* | 216 (1419 bp) | 217 (473 AA) |
| *Euglena gracilis* EgDHAsyn1C20EloDom3-EgD4Dom1 | 218 (2379 bp) | 219 (793 AA) |
| *Euglena gracilis* EgDHAsyn1D4Dom2 | 220 (1623 bp) | 221 (541 AA) |
| *Schizochytrium aggregatum* delta-4 desaturase ("SaD4") | 222 (1530 bp) | — |
| *Schizochytrium aggregatum* delta-4 desaturase ("SaD4*") (internal sbfI site introduced) | 223 (1530 bp) | 224 (510 AA) |
| in-frame fusion between EgDHAsyn1C20EloDom3 and SaD4*, separated by the proline-rich linker region ("EgDHAsyn1C20EloDom3-SaD4*") | 225 (2490 bp) | 226 (830 AA) |
| *Euglena anabaena* EaDHAsyn1 C20 elongase domain | 227 (897 bp) | 231 (299 AA) |
| *Euglena anabaena* EaDHAsyn2 C20 elongase domain | 228 (897 bp) | 232 (299 AA) |
| *Euglena anabaena* EaDHAsyn3 C20 elongase domain | 229 (897 bp) | 233 (299 AA) |
| *Euglena anabaena* EaDHAsyn4 C20 elongase domain | 230 (897 bp) | |

TABLE 2-continued

Summary Of Nucleic Acid And Protein SEQ ID Numbers

| Description and Abbreviation | Nucleic acid SEQ ID NO. | Protein SEQ ID NO. |
|---|---|---|
| *Euglena anabaena* EaDHAsyn1 proline-rich linker | 234 (99 bp) | 235 (33 AA) |
| *Euglena anabaena* EaDHAsyn1 delta-4 desaturase domain 1 | 236 (1527 bp) | 239 (509 AA) |
| *Euglena anabaena* EaDHAsyn2 delta-4 desaturase domain 1 | 237 (1527 bp) | 240 (509 AA) |
| *Euglena anabaena* EaDHAsyn4 delta-4 desaturase domain 1 | 238 (1446 bp) | 241 (482 AA) |
| *Euglena anabaena* EaDHAsyn1 delta-4 desaturase domain 2 (comprising proline-rich linker and a portion of 3' end of C20 elongase domain) | 242 (1749 bp) | 246 (583 AA) |
| *Euglena anabaena* EaDHAsyn2 delta-4 desaturase domain 2 (comprising proline-rich linker and a portion of 3' end of C20 elongase domain) | 243 (1749 bp) | 247 (583 AA) |
| *Euglena anabaena* EaDHAsyn3 delta-4 desaturase domain 2 (comprising proline-rich linker and a portion of 3' end of C20 elongase domain) | 244 (1749 bp) | 248 (583 AA) |
| *Euglena anabaena* EaDHAsyn4 delta-4 desaturase domain 2 (comprising proline-rich linker and a portion of 3' end of C20 elongase domain) | 245 (1668 bp) | 249 (556 AA) |
| Plasmid pLF121-1 | 250 (3668 bp) | — |
| Plasmid pLF121-2 | 251 (3684 bp) | — |
| *Euglena anabaena* delta-9 elongase 1 ("EaD9Elo1"); also referred to herein as "EaD9E" and "EaD9e" | 252 (774 bp) | 254 (258 AA) |
| *Euglena anabaena* delta-9 elongase 2 ("EaD9Elo2") | 253 (774 bp) | 255 (258 AA) |
| Plasmid pLF119 | 256 (4276 bp) | — |
| *Euglena anabaena* delta-5 desaturase 1 ("EaD5Des1" or "EaD5") | 257 (1362 bp) | 258 (454 AA) |
| EaD9-5Bbs primer | 259 | — |
| EaD9-3fusion primer | 260 | — |
| EgDHAsyn1Link-5fusion prime | 261 | — |
| EaD9Elo1-EgDHAsyn1Link | 262 (852 bp) | — |
| Plasmid pLF124 | 263 (5559 bp) | — |
| Plasmid pKR1177 | 264 (5559 bp) | — |
| Plasmid pKR1179 | 265 (7916 bp) | — |
| Plasmid pKR1183 | 266 (9190 bp) | — |
| *Euglena gracilis* delta-5 desaturase ("EgD5") | 267 (1350 bp) | — |
| Plasmid pKR1237 | 268 (6615 bp) | — |
| Plasmid pKR1252 | 269 (6464 bp) | — |
| Plasmid pKR1253 | 270 (10,387 bp) | — |
| oEAd5-1-1 primer | 271 | — |
| oEAd5-1-2 primer | 272 | — |
| Plasmid pKR1136 | 273 (4899 bp) | — |
| Plasmid pKR1139 | 274 (5592 bp) | — |
| Plasmid pKR1255 | 275 (13,293 bp) | — |
| Plasmid pKR561 | 276 (7497 bp) | — |
| Soybean delta-15 desaturase (fad3) (GenBank Accession No. L22964; also called GmFAD3B) | 277 (1143 bp) | — |
| HPfad3-1 primer | 278 | — |
| HPfad3-2 primer | 279 | — |
| HPfad3AB amplicon | 280 (709 bp) | — |
| HPfad3-3 primer | 281 | — |
| HPfad3A'-2 amplicon | 282 (709 bp) | — |
| HPfad3ABA'-2 amplicon | 283 (1014 bp) | — |
| Plasmid pLF129 | 284 (4526 bp) | — |
| Plasmid pKR1189 | 285 (8503 bp) | — |
| Plasmid pKR1209 | 286 (4112 bp) | — |
| GmFad3C (GenBank Accession No. AY204712) | 287 (1143 bp) | 288 (380 AA) |
| fad3c-5 primer | 289 | — |
| fad3c-3 primer | 290 | — |
| Plasmid pKR1213 | 291 (3764 bp) | — |
| Plasmid pKR1218 | 292 (4353 bp) | — |
| Plasmid pKR1210 | 293 (3742 bp) | — |
| Plasmid pKR1219 | 294 (3983 bp) | — |
| Plasmid pKR1225 | 295 (4894 bp) | — |
| Plasmid pKR1229 | 296 (8979 bp) | — |
| Plasmid pKR1249 | 297 (10,221 bp) | — |
| oEAd9el1-1 primer | 298 | — |
| oLINK-1 primer | 299 | — |
| Plasmid pKR1298 | 300 (4362 bp) | — |
| oTPd8-1 primer | 301 | — |
| oTPd8fus-1 primer | 302 | — |
| oLINK-2 primer | 303 | — |
| oLINK-1 primer | 304 | — |

TABLE 2-continued

Summary Of Nucleic Acid And Protein SEQ ID Numbers

| Description and Abbreviation | Nucleic acid SEQ ID NO. | Protein SEQ ID NO. |
|---|---|---|
| TpomD8-EgDHAsyn1Link | 305 (1335 bp) | — |
| Plasmid pKR1291 | 306 (4848 bp) | — |
| Plasmid pKR1301 | 307 (4284 bp) | — |
| Plasmid pKR1301R | 308 (4284 bp) | — |
| Plasmid pKR1311 | 309 (4228 bp) | — |
| Plasmid pKR1304 | 310 (3201 bp) | — |
| Plasmid pKR1309 | 311 (4041 bp) | — |
| Plasmid pKR1313 | 312 (5604 bp) | — |
| Plasmid pKR1315 | 313 (6474 bp) | — |
| Plasmid pKR1322 | 314 (10,627 bp) | — |
| Plasmid pZKLeuN-29E3 | 315 (14,688 bp) | — |
| *Fusarium moniliforme* delta-12 desaturase ("FmD12") | 316 (1434 bp) | 317 (477 AA) |
| Synthetic delta-9 elongase derived from *Euglena gracilis*, codon-optimized for expression in *Yarrowia lipolytica* ("EgD9eS") | 318 (777 bp) | 319 (258 AA) |
| *Escherichia coli* LoxP recombination site, recognized by a Cre recombinase enzyme | 320 (34 bp) | — |
| Synthetic $C_{16/18}$ elongase derived from *Mortierella alpina* ELO3, codon-optimized for expression in *Yarrowia lipolytica* ("ME3S") | 321 (828 bp) | 322 (275 AA) |
| Plasmid pY116 | 323 (8739 bp) | — |
| Plasmid pKO2UF8289 | 324 (15,337 bp) | — |
| *Yarrowia lipolytica* delta-12 desaturase ("YID12") | 325 (1936 bp) | 326 (419 AA) |
| Synthetic mutant delta-8 desaturase ("EgD8M"; U.S. Patent Application No. 11/635258), derived from *Euglena gracilis* ("EgD8S"; PCT Publication No. WO 2006/012326) | 327 (1272 bp) | 328 (422 AA) |
| *Euglena gracilis* delta-9 elongase ("EgD9e") | 329 (777 bp) | 330 (258 AA) |
| Plasmid pZKSL-555R | 331 (13,707 bp) | — |
| Synthetic delta-S desaturase derived from *Euglena gracilis* (U.S. Patent Application No. 11/748629), codon-optimized for expression in *Yarrowia lipolytica* ("EgD5S") | 332 (1350 bp) | 333 (449 AA) |
| Synthetic delta-5 desaturase derived from *Peridinium* sp. CCMP626 (U.S. Patent Application No. 11/748637), codon-optimized for expression in *Yarrowia lipolytica* ("RD5S") | 334 (1392 bp) | 335 (463 AA) |
| *Euglena gracilis* delta-5 desaturase (U.S. Patent Application No. 11/748629) ("EgD5") | 336 (1350 bp) | 337 (449 AA) |
| Plasmid pZP3-Pa777U | 338 (13,066 bp) | — |
| Synthetic delta-17 desaturase derived from *Pythium aphanidermatum*, codon-optimized for expression in *Yarrowia lipolytica* (U.S. Patent Application No. 11/779915) ("PaD17S") | 339 (1080 bp) | 340 (359 AA) |
| *Pythium aphanidermatum* delta-17 desaturase (U.S. Patent Application No. 11/779915) ("PaD17") | 341 (1080 bp) | 342 (359 AA) |
| Plasmid pY117 | 343 (9570 bp) | — |
| *Yarrowia lipolytica* mutant acetohydroxyacid synthase (AHAS) gene comprising a W497L mutation | 344 (2987 bp) | — |
| Plasmid pZP2-2988 | 345 (15,743 bp) | — |
| Synthetic delta-12 desaturase derived from *Fusarium moniliforme*, codon-optimized for expression in *Yarrowia lipolytica* ("FmD12S") | 346 (1434 bp) | 347 (477 AA) |
| Plasmid pZKL2-5U89GC | 348 (15,812 bp) | — |
| *Yarrowia lipolytica* diacylglycerol cholinephosphotransferase gene ("YlCPT1") | 349 (1185 bp) | 350 (394 AA) |
| Plasmid pZKUE3S | 351 (6303 bp) | — |
| Plasmid pZKL1-2SP98C | 352 (15,877 bp) | — |
| Plasmid pZKUM | 353 (4313 bp) | — |
| Synthetic mutant Ura3 gene comprising a 33 bp deletion from +21 to +53, a 1 bp deletion at +376 and a 3 bp deletion from +400 to +403 of the *Yarrowia* Ura3 coding region (GenBank Accession No. AJ306421) | 354 (1459 bp) | — |
| Plasmid pZKD2-5U89A2 | 355 (15,966 bp) | — |
| *Yarrowia lipolytica* diacylglycerol acyltransferase (DGAT2) (PCT Publication No. WO 2005/003322; U.S. Pat. No. 7,267,976) | 356 (2119 bp) | 357 (514 AA) |
| Synthetic delta-9 elongase derived from *Eutreptiella* sp. CCMP389 codon-optimized for expression in *Yarrowia lipolytica* ("E389D9eS") | 358 (792 bp) | 359 (263 AA) |
| Plasmid pZuFmEgC20ES | 360 (7904 bp) | — |

TABLE 2-continued

Summary Of Nucleic Acid And Protein SEQ ID Numbers

| Description and Abbreviation | Nucleic acid SEQ ID NO. | Protein SEQ ID NO. |
|---|---|---|
| Plasmid pZuFmEaC20ES | 361 (7892 bp) | — |
| Plasmid pZKL4-220EA4 | 362 (13,412 bp) | — |
| *Yarrowia lipolytica* lipase 4 like locus (GenBank Accession No. XM_503825) | 363 (1221 bp) | — |
| Plasmid pZuFmEaD4S | 364 (8744 bp) | — |
| Plasmid pZuFmIgD9ES | 365 (7783 bp) | — |
| Primer YL921 | 366 | — |
| Primer YL922 | 367 | — |
| Primer YL923 | 368 | — |
| Primer YL924 | 369 | — |
| Primer YL925 | 370 | — |
| Primer YL926 | 371 | — |
| Plasmid pZuFmEaD4S-M1 | 372 (8746 bp) | — |
| Plasmid pZuFmEaD4S-M2 | 373 (8747 bp) | — |
| Plasmid pZuFmEaD4S-M3 | 374 (8744 bp) | — |
| Plasmid pZuFmEaD4S-1 | 375 (8636 bp) | — |
| Plasmid pZuFmEaD4S-2 | 376 (8576 bp) | — |
| Plasmid pZuFmEaD4S-3 | 377 (8531 bp) | — |
| Plasmid pZKL4-220EA4-1 | 378 (13,304 bp) | — |
| Plasmid pZKL4-220EA4-2 | 379 (13,244 bp) | — |
| Plasmid pZKL4-220EA4-3 | 380 (13,199 bp) | — |
| Truncated synthetic delta-4 desaturase derived from *Euglena anabaena*, codon-optimized for expression in *Yarrowia lipolytica* ("EaD4S-1") | 381 (1644 bp) | 382 (547 AA) |
| Truncated synthetic delta-4 desaturase derived from *Euglena anabaena*, codon-optimized for expression in *Yarrowia lipolytica* ("EaD4S-2") | 383 (1584 bp) | 384 (527 AA) |
| Truncated synthetic delta-4 desaturase derived from *Euglena anabaena*, codon-optimized for expression in *Yarrowia lipolytica* ("EaD4S-3") | 385 (1539 bp) | 386 (512 AA) |
| Synthetic delta-4 desaturase derived from *Euglena gracilis*, codon-optimized for expression in *Yarrowia lipolytica* ("EgD4S") | 387 (1623 bp) | 388 (540 AA) |
| Plasmid pEgD4S | 389 (4343 bp) | — |
| Plasmid pZKL4-220Eg4 | 390 (13,283 bp) | — |
| Primer YL935 | 391 | — |
| Primer YL936 | 392 | — |
| Primer YL937 | 393 | — |
| Primer YL938 | 394 | — |
| Primer YL939 | 395 | — |
| Primer YL940 | 396 | — |
| Plasmid pEgD4S-M1 | 397 (4344 bp) | — |
| Plasmid pEgD4S-M2 | 398 (4346 bp) | — |
| Plasmid pEgD4S-M3 | 399 (4346 bp) | — |
| Plasmid pZKL4-220Eg4-1 | 400 (13,202 bp) | — |
| Plasmid pZKL4-220Eg4-2 | 401 (13,133 bp) | — |
| Plasmid pZKL4-220Eg4-3 | 402 (13,085 bp) | — |
| Truncated synthetic delta-4 desaturase derived from *Euglena gracilis*, codon-optimized for expression in *Yarrowia lipolytica* ("EgD4S-1") | 403 (1542 bp) | 404 (513 AA) |
| Truncated synthetic delta-4 desaturase derived from *Euglena gracilis*, codon-optimized for expression in *Yarrowia lipolytica* ("EgD4S-2") | 405 (1473 bp) | 406 (490 AA) |
| Truncated synthetic delta-4 desaturase derived from *Euglena gracilis*, codon-optimized for expression in *Yarrowia lipolytica* ("EgD4S-3") | 407 (1425 bp) | 408 (474 AA) |
| Plasmid pZKLY-G204 | 409 (10,417 bp) | — |
| Synthetic DHA synthase derived from *Euglena gracilis*, codon-optimized for expression in *Yarrowia lipolytica* ("EgDHAsyn1S") | 410 (2382 bp) | 411 (793 AA) |
| Plasmid pEgC20ES-K | 412 (3632 bp) | — |
| Primer YL973 | 413 | — |
| Primer YL974 | 414 | — |
| Plasmid pYNTGUS1-CNP | 415 (6652 bp) | — |
| Plasmid pZKLY | 416 (9045 bp) | — |
| *Yarrowia lipolytica* lipase 7 locus (GenBank Accession No. AJ549519) | 417 (2173 bp) | 418 (366 AA) |
| *Eutreptiella* sp. CCMP389 delta-9 elongase ("E389D9e") | 419 (792 bp) | 420 (263 AA) |
| Synthetic delta-9 elongase derived from *Euglena anabaena* UTEX 373 codon-optimized for expression in *Yarrowia lipolytica* ("EaD9eS") | 421 (774 bp) | 422 (258 AA) |
| *Euglena gracilis* delta-8 desaturase ("Eg5" or "EgD8") | 423 (1271 bp) | 424 (421 AA) |

TABLE 2-continued

Summary Of Nucleic Acid And Protein SEQ ID Numbers

| Description and Abbreviation | Nucleic acid SEQ ID NO. | Protein SEQ ID NO. |
|---|---|---|
| Synthetic delta-8 desaturase derived from *Euglena gracilis*, codon-optimized for expression in *Yarrowia lipolytica* ("D8SF" or "EgD8S") | 425 (1272 bp) | 426 (422 AA) |
| *Euglena anabaena* UTEX 373 delta-8 desaturase ("EaD8Des3"); also referred to herein as "EaD8" | 427 (1260 bp) | 428 (420 AA) |
| Synthetic delta-8 desaturase derived from *Euglena anabaena* UTEX 373, codon-optimized for expression in *Yarrowia lipolytica* ("EaD8S") | 429 (1260 bp) | 430 (420 AA) |
| Plasmid pZuFmEgD9ES | 431 (7769 bp) | — |
| Plasmid pZuFmEgD9ES-Na | 432 (7778 bp) | — |
| Primer YL989 | 433 | — |
| Primer YL990 | 434 | — |
| Primer YL991 | 435 | — |
| Primer YL992 | 436 | — |
| Plasmid pKO2UFm8A | 437 (8428 bp) | — |
| Modified *Yarrowia* linker GPARPAGLPPATYYDSLAV | — | 438 (19 AA) |
| Plasmid pZUFmG9G8fu | 439 (9098 bp) | — |
| EgD9ES/EgD8M gene fusion | 440 (2106 bp) | 441 (701 AA) |
| Plasmid pZUFmG9G8fu-B | 442 (9104 bp) | — |
| Primer YL1043 | 443 | — |
| Primer YL1044 | 444 | — |
| Modified *Yarrowia* linker GAGPARPAGLPPATYYDSLAVMGS | — | 445 (24 AA) |
| EgD9ES/EgD8M gene fusion | 446 (2112 bp) | 447 (703 AA) |
| Plasmid pEaD8S | 448 (3988 bp) | — |
| Primer YL1059 | 449 | — |
| Primer YL1060 | 450 | — |
| Plasmid pEaD8S-B | 451 (3990 bp) | — |
| Plasmid pZUFmG9A8 | 452 (9101 bp) | — |
| EgD9ES/EaD8S gene fusion | 453 (2109 bp) | 454 (702 AA) |
| Plasmid pZUFmEaD9ES | 455 (7769 bp) | — |
| Plasmid pZUFmEaD9ES-Na | 456 (7775 bp) | — |
| Primer YL1049 | 457 | — |
| Primer YL1050 | 458 | — |
| Plasmid pZUFmA9G8 | 459 (9104 bp) | — |
| EaD9ES/EgD8M gene fusion | 460 (2112 bp) | 461 (703 AA) |
| Plasmid pZUFmA9A8 | 462 (9101 bp) | — |
| EaD9ES/EaD8S gene fusion | 463 (2109 bp) | 464 (702 AA) |
| Plasmid pE389S | 465 (3523 bp) | — |
| Plasmid pE389S-Na | 466 (3529 bp) | — |
| Primer YL1051 | 467 | — |
| Primer YL1052 | 468 | — |
| Plasmid pZUFmR9G8 | 469 (9119 bp) | — |
| E389D9eS/EgD8M gene fusion | 470 (2127 bp) | 471 (708 AA) |
| EgDHAsyn1 proline-rich linker plus 4 amino acids | | 472 (22 AA) |
| Plasmid pKR1007 | 473 (6267 bp) | |
| Plasmid pKR1014 | 474 (11459 bp) | |
| Primer EaD8-5 | 475 (34 bp) | |
| Primer EaD8-3 | 476 (30 bp) | |
| Plasmid pLF120-3 | 477 (4794 bp) | |
| Plasmid pKR1138 | 478 (6526 bp) | |
| Plasmid pKR1152 | 479 (11707 bp) | |
| Primer oEAd9el1-2 | 480 (26 bp) | |
| Plasmid pKR1137 | 481 (4310 bp) | |
| Plasmid pKR1140 | 482 (7872 bp) | |
| Plasmid pKR1145 | 483 (6526 bp) | |
| Plasmid pKR1151 | 484 (11706 bp) | |
| Plasmid pKR1150 | 485 (11706 bp) | |
| Plasmid pKR1190 | 486 (5559 bp) | |
| Plasmid pKR1195 | 487 (6833 bp) | |
| Plasmid pKR1199 | 488 (9190 bp) | |
| Plasmid pKR1196 | 489 (6833 bp) | |
| Plasmid pKR1200 | 490 (9190 bp) | |
| Plasmid pKR1184 | 491 (9190 bp) | |
| EgD9e/TpomD8 fusion | 492 (2103 bp) | 515 (700 AA) |
| EgD9e/EaD8 fusion | 493 (2103 bp) | 516 (700 AA) |
| EaD9e/TpomD8 fusion | 494 (2103 bp) | 517 (700 AA) |
| EaD9e/EaD8 fusion | 495 (2103 bp) | 518 (700 AA) |
| EgD9e/PavD8 fusion | 496 (2112 bp) | 519 (703 AA) |
| Plasmid pKR1303 | 497 (3967 bp) | |
| Plasmid pKR1308 | 498 (4754 bp) | |
| Plasmid pKR393 | 499 (5250 bp) | |
| Plasmid pKR407 | 500 (4140 bp) | |

TABLE 2-continued

Summary Of Nucleic Acid And Protein SEQ ID Numbers

| Description and Abbreviation | Nucleic acid SEQ ID NO. | Protein SEQ ID NO. |
|---|---|---|
| Plasmid pKR1018 | 501 (5414 bp) | |
| Plasmid pKR1312 | 502 (5731 bp) | |
| Plasmid pKR1321 | 503 (9198 bp) | |
| EaDHAsyn1 proline-rich linker plus 3 amino acids | | 504 (36 AA) |
| Primer EaLink1 | 505 (35 bp) | |
| Primer EaLink2 | 506 (35 bp) | |
| Primer EaLink3 | 507 (19 bp) | |
| EaD9e-EaDHAsyn1Link | 508 (894 bp) | |
| Plasmid pKR1305 | 509 (4405 bp) | |
| Plasmid pKR1317 | 510 (3201 bp) | |
| Plasmid pKR1320 | 511 (5816 bp) | |
| Plasmid pKR1326 | 512 (9241 bp) | |

DETAILED DESCRIPTION OF THE INVENTION

The disclosure of each reference set forth herein is hereby incorporated by reference in its entirety.

The present invention relates to multizymes, such as DHA synthase. These are useful for, inter alia, the manipulation of biochemical pathways for the production of healthful PUFAs and more specifically for the production of docosahexaenoic acid (DHA). Thus, the subject invention finds many applications. PUFAs, or derivatives thereof, made by the methodology disclosed herein can be used as dietary substitutes, or supplements, particularly infant formulas, for patients undergoing intravenous feeding or for preventing or treating malnutrition.

Alternatively, the purified PUFAs (or derivatives thereof) may be incorporated into cooking oils, fats, or margarines formulated so that in normal use the recipient would receive the desired amount for dietary supplementation. The PUFAs may also be incorporated into infant formulas, nutritional supplements, or other food products and may find use as anti-inflammatory or cholesterol lowering agents. Optionally, the compositions may be used for pharmaceutical use (human or veterinary). In this case, the PUFAs are generally administered orally but can be administered by any route by which they may be successfully absorbed, e.g., parenterally (e.g., subcutaneously, intramuscularly or intravenously), rectally, vaginally, or topically (e.g., as a skin ointment or lotion).

Supplementation of humans or animals with PUFAs produced by recombinant means can result in increased levels of the added PUFAs, as well as their metabolic progeny. For example, treatment with EPA can result not only in increased levels of EPA, but also downstream products of EPA such as eicosanoids (i.e., prostaglandins, leukotrienes, thromboxanes). Complex regulatory mechanisms can make it desirable to combine various PUFAs, or add different conjugates of PUFAs, in order to prevent, control, or overcome such mechanisms to achieve the desired levels of specific PUFAs in an individual.

DEFINITIONS

As used herein and in the appended claims, the singular forms "a", "an", and "the" include plural reference unless the context clearly dictates otherwise. Thus, for example, reference to "a plant" includes a plurality of such plants, reference to "a cell" includes one or more cells and equivalents thereof known to those skilled in the art, and so forth.

The term "invention" or "present invention" as used herein is not meant to be limiting to any one specific embodiment of the invention but applies generally to any and all embodiments of the invention as described in the claims and specification.

In the context of this disclosure, a number of terms and abbreviations are used. The following definitions are provided.

"Open reading frame" is abbreviated ORF.
"Polymerase chain reaction" is abbreviated PCR.
"American Type Culture Collection" is abbreviated ATCC.
"Polyunsaturated fatty acid(s)" is abbreviated PUFA(s).
"Triacylglycerols" are abbreviated TAGs.

The terms "down-regulate or down-regulation", as used herein, refer to a reduction or decrease in the level of expression of a gene or polynucleotide.

The term "multizyme" refers to a single polypeptide having at least two independent and separable enzymatic activities. Preferably, the multizyme comprises a first enzymatic activity linked to a second enzymatic activity.

The term "fusion protein" is used interchangeably with the term "multizyme". Thus, a "fusion protein" refers to a single polypeptide having at least two independent and separable enzymatic activities.

The term "fusion gene" refers to a polynucleotide or gene that encodes a multizyme. A fusion gene can be constructed by linking at least two DNA fragments, wherein each DNA fragment encodes for an independent and separate enzyme activity. An example of a fusion gene is described herein below in Example 38, in which the Hybrid1-HGLA Synthase fusion gene was constructed by linking the *Euglena anabaena* delta-9 elongase (EaD9Elo1; SEQ ID NO:252) and the *Tetruetreptia pomquetensis* CCMP1491 delta-8 desaturase (TpomD8; SEQ ID NO:162) using the *Euglena gracilis* DHA synthase 1 proline-rich linker. (EgDHAsyn1 Link; SEQ ID NO:197).

A "domain" or "functional domain" is a discrete, continuous part or subsequence of a polypeptide that can be associated with a function (e.g. enzymatic activity). As used herein, the term "domain" includes but is not limited to fatty acid biosynthetic enzymes and portions of fatty acid biosynthetic enzymes that retain enzymatic activity.

"DHA synthase" is an example of a multizyme. Specifically, a DHA synthase comprises a C20 elongase linked to a delta-4 desaturase using any of the linkers described herein. Another example of a multizyme is a single polypeptide comprising a delta-9 elongase linked to a delta-8 desaturase as discussed below.

The term "link" refers to joining or bonding at least two polypeptides having independent and separable enzyme activities.

The term "linker" refers to the bond or link between two or more polypeptides each having independent and separable enzymatic activities The link used to form a multizyme is minimally comprised of a single polypeptide bond. In another aspect, the link may be comprised of one amino acid residue, such as proline, or a polypeptide. If the link is a polypeptide, it may be desirable for the link to have at least one proline amino acid residue.

An example of a linker is shown in SEQ ID NO:198 (the EgDHAsyn1 proline-rich linker).

The term "fatty acids" refers to long-chain aliphatic acids (alkanoic acids) of varying chain lengths, from about $C_{12}$ to $C_{22}$ (although both longer and shorter chain-length acids are known). The predominant chain lengths are between $C_{16}$ and $C_{22}$. Additional details concerning the differentiation between "saturated fatty acids" versus "unsaturated fatty acids", "monounsaturated fatty acids" versus "polyunsaturated fatty acids" (or "PUFAs"), and "omega-6 fatty acids" (ω-6 or n-6) versus "omega-3 fatty acids" (omega-3 or n-3) are provided in U.S. Pat. No. 7,238,482.

Fatty acids are described herein by a simple notation system of "X:Y", wherein X is the total number of carbon (C) atoms in the particular fatty acid and Y is the number of double bonds. The number following the fatty acid designation indicates the position of the double bond from the carboxyl end of the fatty acid with the "c" affix for the cis-configuration of the double bond (e.g., palmitic acid (16:0), stearic acid (18:0), oleic acid (18:1, 9c), petroselinic acid (18:1, 6c), LA (18:2, 9c, 12c), GLA (18:3,6c,9c,12c) and ALA (18:3,9c,12c,15c)). Unless otherwise specified, 18:1, 18:2 and 18:3 refer to oleic, LA and ALA fatty acids, respectively. If not specifically written as otherwise, double bonds are assumed to be of the cis configuration. For instance, the double bonds in 18:2 (9,12) would be assumed to be in the cis configuration.

Nomenclature used to describe PUFAs in the present disclosure is shown below in Table 3. In the column titled "Shorthand Notation", the omega-reference system is used to indicate the number of carbons, the number of double bonds and the position of the double bond closest to the omega carbon, counting from the omega carbon (which is numbered 1 for this purpose). The remainder of the table summarizes the common names of omega-3 and omega-6 fatty acids and their precursors, the abbreviations that will be used throughout the remainder of the specification, and each compounds' chemical name.

TABLE 3

Nomenclature of Polyunsaturated Fatty Acids and Precursors

| Common Name | Abbreviation | Chemical Name | Shorthand Notation |
|---|---|---|---|
| myristic | — | tetradecanoic | 14:0 |
| palmitic | PA or Palmitate | hexadecanoic | 16:0 |
| palmitoleic | — | 9-hexadecenoic | 16:1 |
| stearic | — | octadecanoic | 18:0 |
| oleic | — | cis-9-octadecenoic | 18:1 |
| linoleic | LA | cis-9,12-octadecadienoic | 18:2 ω-6 |
| gamma-linolenic | GLA | cis-6,9,12-octadecatrienoic | 18:3 ω-6 |
| eicosadienoic | EDA | cis-11,14-eicosadienoic | 20:2 ω-6 |
| dihomo-gamma-linolenic | DGLA or HGLA (used interchangeably herein) | cis-8,11,14-eicosatrienoic | 20:3 ω-6 |

TABLE 3-continued

Nomenclature of Polyunsaturated Fatty Acids and Precursors

| Common Name | Abbreviation | Chemical Name | Shorthand Notation |
|---|---|---|---|
| sciadonic | SCI | cis-5,11,14-eicosatrienoic | 20:3b ω-6 |
| arachidonic | ARA | cis-5,8,11,14-eicosatetraenoic | 20:4 ω-6 |
| alpha-linolenic | ALA | cis-9,12,15-octadecatrienoic | 18:3 ω-3 |
| stearidonic | STA | cis-6,9,12,15-octadecatetraenoic | 18:4 ω-3 |
| eicosatrienoic | ETrA or ERA | cis-11,14,17-eicosatrienoic | 20:3 ω-3 |
| eicosa-tetraenoic | ETA | cis-8,11,14,17-eicosatetraenoic | 20:4 ω-3 |
| juniperonic | JUP | cis-5,11,14,17-eicosatrienoic | 20:4b ω-3 |
| eicosa-pentaenoic | EPA | cis-5,8,11,14,17-eicosapentaenoic | 20:5 ω-3 |
| docosa-trienoic | DRA | cis-10,13,16-docosatrienoic | 22:3 ω-3 |
| docosa-tetraenoic | DTA | cis-7,10,13,16-docosatetraenoic | 22:4 ω-3 |
| docosa-pentaenoic | DPAn-6 | cis-4,7,10,13,16-docosapentaenoic | 22:5 ω-6 |
| docosa-pentaenoic | DPA | cis-7,10,13,16,19-docosapentaenoic | 22:5 ω-3 |
| docosa-hexaenoic | DHA | cis-4,7,10,13,16,19-docosahexaenoic | 22:6 ω-3 |

A metabolic, or biosynthetic, pathway, in a biochemical sense, can be regarded as a series of chemical reactions occurring within a cell, catalyzed by enzymes, to achieve either the formation of a metabolic product to be used or stored by the cell, or the initiation of another metabolic pathway (then called a flux generating step). Many of these pathways are elaborate, and involve a step by step modification of the initial substance to shape it into a product having the exact chemical structure desired.

The term "PUFA biosynthetic pathway" refers to a metabolic process that converts oleic acid to LA, EDA, GLA, DGLA, ARA, DTA, DPAn-6, ALA, STA, ETrA, ETA, EPA, DPA and DHA. This process is well described in the literature (e.g., see PCT Publication No. WO 2006/052870). Simplistically, this process involves elongation of the carbon chain through the addition of carbon atoms and desaturation of the molecule through the addition of double bonds, via a series of special desaturation and elongation enzymes (i.e., "PUFA biosynthetic pathway enzymes") present in the endoplasmic reticulum membrane. More specifically, "PUFA biosynthetic pathway enzyme" refers to any of the following enzymes (and genes which encode said enzymes) associated with the biosynthesis of a PUFA, including: a delta-4 desaturase, a delta-5 desaturase, a delta-6 desaturase, a delta-12 desaturase, a delta-15 desaturase, a delta-17 desaturase, a delta-9 desaturase, a delta-8 desaturase, a delta-9 elongase, a $C_{14/16}$ elongase, a $C_{16/18}$ elongase, a $C_{18/20}$ elongase, a $C_{20/22}$ elongase, a DHA synthase and/or a multizyme of the instant invention.

Figure 1:
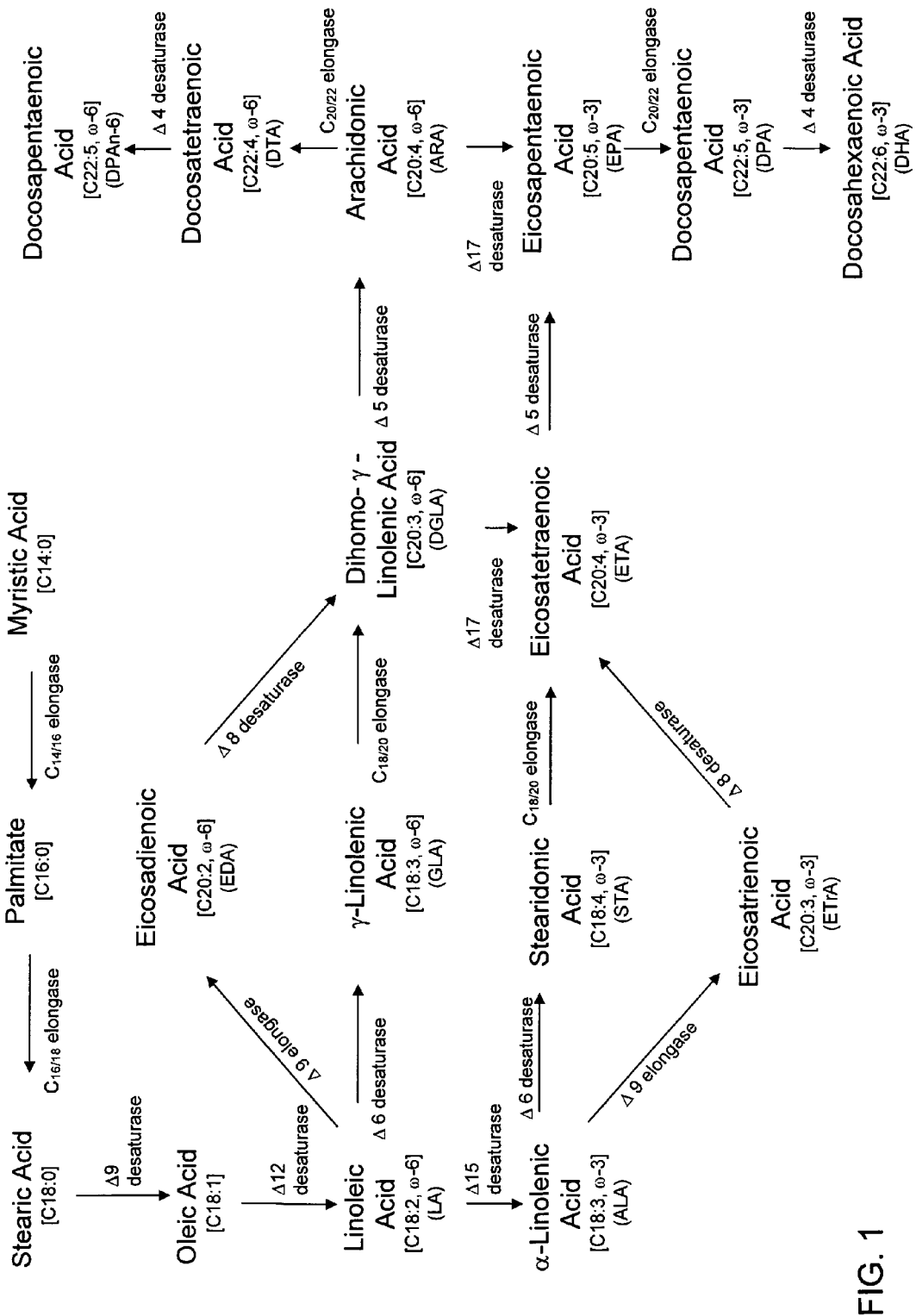

The term "omega-3/omega-6 fatty acid biosynthetic pathway" refers to a set of genes which, when expressed under the appropriate conditions encode enzymes that catalyze the production of either or both omega-3 and omega-6 fatty acids. Typically the genes involved in the omega-3/omega-6 fatty acid biosynthetic pathway encode PUFA biosynthetic pathway enzymes. A representative pathway is illustrated in FIG. 1, providing for the conversion of myristic acid through various intermediates to DHA, which demonstrates how both omega-3 and omega-6 fatty acids may be produced from a common source. The pathway is naturally divided into two portions where one portion will generate omega-3 fatty acids and the other portion, omega-6 fatty acids.

The term "functional" as used herein in context with the omega-3/omega-6 fatty acid biosynthetic pathway means that some (or all) of the genes in the pathway express active enzymes, resulting in in vivo catalysis or substrate conversion. It should be understood that "omega-3/omega-6 fatty acid biosynthetic pathway" or "functional omega-3/omega-6 fatty acid biosynthetic pathway" does not imply that all the PUFA biosynthetic pathway enzyme genes are required, as a number of fatty acid products will only require the expression of a subset of the genes of this pathway.

The term "delta-6 desaturase/delta-6 elongase pathway" refers to a PUFA biosynthetic pathway that minimally includes at least one delta-6 desaturase and at least one $C_{18/20}$ elongase, thereby enabling biosynthesis of DGLA and/or ETA from LA and ALA, respectively, with GLA and/or STA as intermediate fatty acids. With expression of other desaturases and elongases, ARA, DTA, DPAn-6, EPA, DPA, and DHA may also be synthesized.

The term "delta-9 elongase/delta-8 desaturase pathway" refers to a PUFA biosynthetic pathway that minimally comprises at least one delta-9 elongase and at least one delta-8 desaturase, thereby enabling biosynthesis of DGLA and/or ETA from LA and ALA, respectively, with EDA and/or ETrA as intermediate fatty acids With expression of other desaturases and elongases, ARA, DTA, DPAn-6, EPA, DPA and DHA may also be synthesized. This pathway may be advantageous in some embodiments, as the biosynthesis of GLA and/or STA is excluded.

The term "intermediate fatty acid" refers to any fatty acid produced in a fatty acid metabolic pathway that can be further converted to an intended product fatty acid in this pathway by the action of other metabolic pathway enzymes. For instance, when EPA is produced using the delta-9 elongase/delta-8 desaturase pathway, EDA, ETrA, DGLA, ETA and ARA can be produced and are considered "intermediate fatty acids" since these fatty acids can be further converted to EPA via action of other metabolic pathway enzymes.

The term "by-product fatty acid" refers to any fatty acid produced in a fatty acid metabolic pathway that is not the intended fatty acid product of the pathway nor an "intermediate fatty acid" of the pathway. For instance, when EPA is produced using the delta-9 elongase/delta-8 desaturase pathway, sciadonic acid (SCI) and juniperonic acid (JUP) also can be produced by the action of a delta-5 desaturase on either EDA or ETrA, respectively. They are considered to be "by-product fatty acids" since neither can be further converted to EPA by the action of other metabolic pathway enzymes.

The terms "triacylglycerol", "oil" and "TAGs" refer to neutral lipids composed of three fatty acyl residues esterified to a glycerol molecule (and such terms will be used interchangeably throughout the present disclosure herein). Such oils can contain long-chain PUFAs, as well as shorter saturated and unsaturated fatty acids and longer chain saturated fatty acids. Thus, "oil biosynthesis" generically refers to the synthesis of TAGs in the cell.

"Percent (%) PUFAs in the total lipid and oil fractions" refers to the percent of PUFAs relative to the total fatty acids in those fractions. The term "total lipid fraction" or "lipid fraction" both refer to the sum of all lipids (i.e., neutral and polar) within an oleaginous organism, thus including those lipids that are located in the phosphatidylcholine (PC) fraction, phosphatidylethanolamine (PE) fraction and triacylglycerol (TAG or oil) fraction. However, the terms "lipid" and "oil" will be used interchangeably throughout the specification.

The terms "conversion efficiency" and "percent substrate conversion" refer to the efficiency by which a particular enzyme (e.g., a desaturase) can convert substrate to product. The conversion efficiency is measured according to the following formula: ([product]/[substrate+product])*100, where 'product' includes the immediate product and all products in the pathway derived from it.

"Desaturase" is a polypeptide that can desaturate, i.e., introduce a double bond, in one or more fatty acids to produce a fatty acid or precursor of interest. Despite use of the omega-reference system throughout the specification to refer to specific fatty acids, it is more convenient to indicate the activity of a desaturase by counting from the carboxyl end of the substrate using the delta-system. For example, delta-8 desaturases will desaturate a fatty acid between the eighth and ninth carbon atom numbered from the carboxyl-terminal end of the molecule and can, for example, catalyze the conversion of EDA to DGLA and/or ETrA to ETA. Other useful fatty acid desaturases include, for example: (1) delta-5 desaturases that catalyze the conversion of DGLA to ARA and/or ETA to EPA; (2) delta-6 desaturases that catalyze the conversion of LA to GLA and/or ALA to STA; (3) delta-4 desaturases that catalyze the conversion of DPA to DHA and/or DTA to DPAn-6; (4) delta-12 desaturases that catalyze the conversion of oleic acid to LA; (5) delta-15 desaturases that catalyze the conversion of LA to ALA and/or GLA to STA; (6) delta-17 desaturases that catalyze the conversion of ARA to EPA and/or DGLA to ETA; and (7) delta-9 desaturases that catalyze the conversion of palmitic acid to palmitoleic acid (16:1) and/or stearic acid to oleic acid (18:1). In the art, delta-15 and delta-17 desaturases are also occasionally referred to as "omega-3 desaturases", "w-3 desaturases", and/or "n-3 desaturases", based on their ability to convert omega-6 fatty acids into their omega-3 counterparts (e.g., conversion of LA into ALA and ARA into EPA, respectively). In some embodiments, it is most desirable to empirically determine the specificity of a particular fatty acid desaturase by transforming a suitable host with the gene for the fatty acid desaturase and determining its effect on the fatty acid profile of the host.

The term "delta-4 desaturase" refers to an enzyme that will desaturate a fatty acid between the fourth and fifth carbon atom numbered from the carboxyl-terminal end of the molecule and that can, for example, catalyze the conversion of DPA to DHA and/or DTA to DPAn-6. For the purposes herein, the term "EgDHAsyn1" refers to a DHA synthase enzyme (SEQ ID NO:12) isolated from *Euglena gracilis*, encoded by SEQ ID NO:11 herein. The term "EgDHAsyn2" refers to a DHA synthase enzyme (SEQ ID NO:22) isolated from *Euglena gracilis*, encoded by SEQ ID NO:21 herein. The term "EaDHAsyn1" refers to a DHA synthase enzyme (SEQ ID NO:95) isolated from *Euglena anabaena*, encoded by SEQ ID NO:91 herein. The term "EaDHAsyn2" refers to a DHA synthase enzyme (SEQ ID NO:96) isolated from *Euglena anabaena*, encoded by SEQ ID NO:92 herein. The term "EaDHAsyn3" refers to a DHA synthase enzyme (SEQ ID NO:97) isolated from *Euglena anabaena*, encoded by SEQ ID NO:93 herein. The term "EaDHAsyn4" refers to an enzyme (SEQ ID NO:98) isolated from *Euglena anabaena*, encoded by SEQ ID NO:94 herein.

The term "elongase system" refers to a suite of four enzymes that are responsible for elongation of a fatty acid carbon chain to produce a fatty acid that is two carbons longer than the fatty acid substrate that the elongase system acts upon. More specifically, the process of elongation occurs in association with fatty acid synthase, whereby CoA is the acyl carrier (Lassner et al., Plant Cell 8:281-292 (1996)). In the first step, which has been found to be both substrate-specific and also rate-limiting, malonyl-CoA is condensed with a long-chain acyl-CoA to yield carbon dioxide ($CO_2$) and a β-ketoacyl-CoA (where the acyl moiety has been elongated by two carbon atoms). Subsequent reactions include reduction to β-hydroxyacyl-CoA, dehydration to an enoyl-CoA and a second reduction to yield the elongated acyl-CoA. Examples of reactions catalyzed by elongase systems are the conversion of GLA to DGLA, STA to ETA, LA to EDA, ALA to ETrA and EPA to DPA.

For the purposes herein, an enzyme catalyzing the first condensation reaction (i.e., conversion of malonyl-CoA and long-chain acyl-CoA to β-ketoacyl-CoA) will be referred to generically as an "elongase". In general, the substrate selectivity of elongases is somewhat broad but segregated by both chain length and the degree of unsaturation. Accordingly, elongases can have different specificities. For example, a $C_{14/16}$ elongase will utilize a $C_{14}$ substrate (e.g., myristic acid); a $C_{16/18}$ elongase will utilize a $C_{16}$ substrate (e.g., palmitate); a $C_{18/20}$ elongase will utilize a $C_{18}$ substrate (e.g., GLA, STA); and a $C_{20/22}$ elongase will utilize a $C_{20}$ substrate (e.g., ARA, EPA). Similarly, a "delta-9 elongase" is able to catalyze the conversion of LA to EDA and/or ALA to ETrA.

It is important to note that some elongases have broad specificity and thus a single enzyme may be capable of catalyzing several elongase reactions. Thus, for example, a delta-9 elongase may also act as a $C_{16/18}$ elongase, $C_{18/20}$ elongase and/or $C_{20/22}$ elongase and may have alternate, but not preferred, specificities for delta-5 and delta-6 fatty acids such as EPA and/or GLA, respectively.

The term "C20 elongase" as used herein refers to an enzyme which utilizes a C20 substrate such as EPA or ARA, for example. The term "C20/delta-5 elongase" refers to an enzyme that utilizes a C20 substrate with a delta-5 double bond.

Similarly for the purposes herein, the term "EgD9elo" or "EgD9e" refers to a delta-9 elongase isolated from *Euglena gracilis* (see SEQ ID NO:112; also see U.S. application Ser. No. 11/601,563 (filed Nov. 16, 2006, which published as US-2007-0118929-A1 on May 24, 2007)).

As used herein, "nucleic acid" means a polynucleotide and includes a single or double-stranded polymer of deoxyribonucleotide or ribonucleotide bases. Nucleic acids may also include fragments and modified nucleotides. Thus, the terms "polynucleotide", "nucleic acid sequence", "nucleotide sequence" or "nucleic acid fragment" are used interchangeably and refer to a polymer of RNA or DNA that is single- or double-stranded, optionally containing synthetic, non-natural or altered nucleotide bases. Nucleotides (usually found in their 5'-monophosphate form) are referred to by their single letter designation as follows: "A" for adenylate or deoxyadenylate (for RNA or DNA, respectively), "C" for cytidylate or deoxycytidylate, "G" for guanylate or deoxyguanylate, "U" for uridylate, "T" for deoxythymidylate, "R" for purines (A or G), "Y" for pyrimidines (C or T), "K" for G or T, "H" for A or C or T, "I" for inosine, and "N" for any nucleotide.

The terms "subfragment that is functionally equivalent" and "functionally equivalent subfragment" are used interchangeably herein. These terms refer to a portion or subsequence of an isolated nucleic acid fragment in which the ability to alter gene expression or produce a certain phenotype is retained whether or not the fragment or subfragment encodes an active enzyme. For example, the fragment or subfragment can be used in the design of chimeric genes to produce the desired phenotype in a transformed plant. Chimeric genes can be designed for use in suppression by linking a nucleic acid fragment or subfragment thereof, whether or not it encodes an active enzyme, in the sense or antisense orientation relative to a plant promoter sequence.

The term "conserved domain" or "motif" means a set of amino acids conserved at specific positions along an aligned sequence of evolutionarily related proteins. While amino acids at other positions can vary between homologous proteins, amino acids that are highly conserved at specific positions indicate amino acids that are essential in the structure, the stability, or the activity of a protein. The terms "homology", "homologous", "substantially similar" and "corresponding substantially" are used interchangeably herein. They refer to nucleic acid fragments wherein changes in one or more nucleotide bases do not affect the ability of the nucleic acid fragment to mediate gene expression or produce a certain phenotype. These terms also refer to modifications of the nucleic acid fragments of the instant invention such as deletion or insertion of one or more nucleotides that do not substantially alter the functional properties of the resulting nucleic acid fragment relative to the initial, unmodified fragment. It is therefore understood, as those skilled in the art will appreciate, that the invention encompasses more than the specific exemplary sequences.

Moreover, the skilled artisan recognizes that substantially similar nucleic acid sequences encompassed by this invention are also defined by their ability to hybridize (under moderately stringent conditions, e.g., 0.5×SSC, 0.1% SDS, 60° C.) with the sequences exemplified herein, or to any portion of the nucleotide sequences disclosed herein and which are functionally equivalent to any of the nucleic acid sequences disclosed herein. Stringency conditions can be adjusted to screen for moderately similar fragments, such as homologous sequences from distantly related organisms, to highly similar fragments, such as genes that duplicate functional enzymes from closely related organisms. Post-hybridization washes determine stringency conditions.

The term "selectively hybridizes" includes reference to hybridization, under stringent hybridization conditions, of a nucleic acid sequence to a specified nucleic acid target sequence to a detectably greater degree (e.g., at least 2-fold over background) than its hybridization to non-target nucleic acid sequences and to the substantial exclusion of non-target nucleic acids. Selectively hybridizing sequences typically have about at least 80% sequence identity, or 90% sequence identity, up to and including 100% sequence identity (i.e., fully complementary) with each other.

The term "stringent conditions" or "stringent hybridization conditions" includes reference to conditions under which a probe will selectively hybridize to its target sequence. Stringent conditions are sequence-dependent and will be different in different circumstances. By controlling the stringency of the hybridization and/or washing conditions, target sequences can be identified which are 100% complementary to the probe (homologous probing). Alternatively, stringency conditions can be adjusted to allow some mismatching in sequences so that lower degrees of similarity are detected (heterologous probing). Generally, a probe is less than about 1000 nucleotides in length, optionally less than 500 nucleotides in length.

Typically, stringent conditions will be those in which the salt concentration is less than about 1.5 M Na ion, typically about 0.01 to 1.0 M Na ion concentration (or other salts) at pH 7.0 to 8.3 and the temperature is at least about 30° C. for short probes (e.g., 10 to 50 nucleotides) and at least about 60° C. for long probes (e.g., greater than 50 nucleotides). Stringent conditions may also be achieved with the addition of destabilizing agents such as formamide. Exemplary low stringency conditions include hybridization with a buffer solution of 30 to 35% formamide, 1 M NaCl,1% SDS (sodium dodecyl sulphate) at 37° C., and a wash in 1× to 2×SSC (20×SSC=3.0 M NaCl/0.3 M trisodium citrate) at 50 to 55° C. Exemplary moderate stringency conditions include hybridization in 40 to 45% formamide, 1 M NaCl,1% SDS at 37° C., and a wash in 0.5× to 1×SSC at 55 to 60° C. Exemplary high stringency conditions include hybridization in 50% formamide, 1 M NaCl, 1% SDS at 37° C., and a wash in 0.1×SSC at 60 to 65° C.

Specificity is typically the function of post-hybridization washes, the critical factors being the ionic strength and temperature of the final wash solution. For DNA-DNA hybrids, the $T_m$ can be approximated from the equation of Meinkoth et al., *Anal. Biochem.* 138:267-284 (1984): $T_m$=81.5° C.+16.6 (log M)+0.41 (% GC)−0.61 (% form)-500/L; where M is the molarity of monovalent cations, % GC is the percentage of guanosine and cytosine nucleotides in the DNA, % form is the percentage of formamide in the hybridization solution, and L is the length of the hybrid in base pairs. The $T_m$ is the temperature (under defined ionic strength and pH) at which 50% of a complementary target sequence hybridizes to a perfectly matched probe. $T_m$ is reduced by about 1° C. for each 1% of mismatching; thus, $T_m$, hybridization and/or wash conditions can be adjusted to hybridize to sequences of the desired identity. For example, if sequences with ≥90% identity are sought, the $T_m$ can be decreased 10° C. Generally, stringent conditions are selected to be about 5° C. lower than the thermal melting point ($T_m$) for the specific sequence and its complement at a defined ionic strength and pH. However, severely stringent conditions can utilize a hybridization and/or wash at 1, 2, 3, or 4° C. lower than the thermal melting point ($T_m$); moderately stringent conditions can utilize a hybridization and/or wash at 6, 7, 8, 9, or 10° C. lower than the thermal melting point ($T_m$); low stringency conditions can utilize a hybridization and/or wash at 11,12,13,14,15, or 20° C. lower than the thermal melting point ($T_m$). Using the equation, hybridization and wash compositions, and desired $T_m$, those of ordinary skill will understand that variations in the stringency of hybridization and/or wash solutions are inherently described. If the desired degree of mismatching results in a $T_m$ of less than 45° C. (aqueous solution) or 32° C. (formamide solution) it is preferred to increase the SSC concentration so that a higher temperature can be used. An extensive guide to the hybridization of nucleic acids is found in Tijssen, *Laboratory Techniques in Biochemistry and Molecular Biology—Hybridization with Nucleic Acid Probes*, Part I, Chapter 2 "Overview of principles of hybridization and the strategy of nucleic acid probe assays", Elsevier, N.Y. (1993); and *Current Protocols in Molecular Biology*, Chapter 2, Ausubel et al., Eds., Greene Publishing and Wiley-Interscience, New York (1995). Hybridization and/or wash conditions can be applied for at least 10, 30, 60, 90, 120, or 240 minutes.

"Sequence identity" or "identity" in the context of nucleic acid or polypeptide sequences refers to the nucleic acid bases or amino acid residues in two sequences that are the same when aligned for maximum correspondence over a specified comparison window.

Thus, "percentage of sequence identity" refers to the value determined by comparing two optimally aligned sequences over a comparison window, wherein the portion of the polynucleotide or polypeptide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison and multiplying the results by 100 to yield the percentage of sequence identity. Useful examples of percent sequence identities include, but are not limited to, 50%, 55%, 60%, 65%, 70%, 75%, 80%, 85%, 90%, or 95%, or any integer percentage from 50% to 100%. These identities can be determined using any of the programs described herein.

Sequence alignments and percent identity or similarity calculations may be determined using a variety of comparison methods designed to detect homologous sequences including, but not limited to, the MegAlign™ program of the LASERGENE bioinformatics computing suite (DNASTAR Inc., Madison, Wis.). Within the context of this application it will be understood that where sequence analysis software is used for analysis, that the results of the analysis will be based on the "default values" of the program referenced, unless otherwise specified. As used herein "default values" will mean any set of values or parameters that originally load with the software when first initialized.

The "Clustal V method of alignment" corresponds to the alignment method labeled Clustal V (described by Higgins and Sharp, *CABIOS.* 5:151-153 (1989); Higgins, D. G. et al., *Comput. Appl. Biosci.* 8:189-191 (1992)) and found in the MegAlign™ program of the LASERGENE bioinformatics computing suite (DNASTAR Inc., Madison, Wis.). For multiple alignments, the default values correspond to GAP PENALTY=10 and GAP LENGTH PENALTY=10. Default parameters for pairwise alignments and calculation of percent identity of protein sequences using the Clustal V method are KTUPLE=1, GAP PENALTY=3, WINDOW=5 and DIAGONALS SAVED=5. For nucleic acids these parameters are KTUPLE=2, GAP PENALTY=5, WINDOW=4 and DIAGONALS SAVED=4. After alignment of the sequences using the Clustal V program, it is possible to obtain a "percent identity" by viewing the "sequence distances" table in the same program.

The "Clustal W method of alignment" corresponds to the alignment method labeled Clustal W (described by Higgins and Sharp, supra; Higgins, D. G. et al., supra) and found in the MegAlign™ v6.1 program of the LASERGENE bioinformatics computing suite (DNASTAR Inc., Madison, Wis.). Default parameters for multiple alignment correspond to GAP PENALTY=10, GAP LENGTH PENALTY=0.2, Delay Divergen Seqs (%)=30, DNA Transition Weight=0.5, Protein Weight Matrix=Gonnet Series, DNA Weight Matrix=IUB. After alignment of the sequences using the Clustal W program, it is possible to obtain a "percent identity" by viewing the "sequence distances" table in the same program.

"BLASTN method of alignment" is an algorithm provided by the National Center for Biotechnology Information (NCBI) to compare nucleotide sequences using default parameters.

It is well understood by one skilled in the art that many levels of sequence identity are useful in identifying polypeptides, from other species, wherein such polypeptides have the same or similar function or activity. Useful examples of percent identities include, but are not limited to, 50%, 55%, 60%, 65%, 70%, 75%, 80%, 85%, 90%, or 95%, or any integer percentage from 50% to 100%. Indeed, any integer amino acid identity from 50% to 100% may be useful in describing the present invention, such as 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99%. Also, of interest is any full-length or partial complement of this isolated nucleotide fragment.

"Gene" refers to a nucleic acid fragment that expresses a specific protein and can include either the coding region alone or the coding region in addition to the regulatory sequences preceding (5' non-coding sequences) and following (3' non-coding sequences) the coding sequence. "Native gene" refers to a gene as found in nature with its own regulatory sequences. "Chimeric gene" refers to any gene that is not a native gene, comprising regulatory and coding sequences that are not found together in nature. Accordingly, a chimeric gene may comprise regulatory sequences and coding sequences that are derived from different sources, or regulatory sequences and coding sequences derived from the same source, but arranged in a manner different than that found in nature. "Endogenous gene" refers to a native gene in its natural location in the genome of an organism. A "foreign" gene refers to a gene not normally found in the host organism, but that is introduced into the host organism by gene transfer. Foreign genes can comprise native genes inserted into a non-native organism, or chimeric genes. A "transgene" is a gene that has been introduced into the genome by a transformation procedure.

The term "genome" as it applies to plant cells encompasses not only chromosomal DNA found within the nucleus, but organelle DNA found within subcellular components (e.g., mitochondrial, plastid) of the cell.

A "codon-optimized gene" is a gene having its frequency of codon usage designed to mimic the frequency of preferred codon usage of the host cell.

An "allele" is one of several alternative forms of a gene occupying a given locus on a chromosome. When all the alleles present at a given locus on a chromosome are the same that plant is homozygous at that locus. If the alleles present at a given locus on a chromosome differ that plant is heterozygous at that locus.

"Coding sequence" refers to a DNA sequence that codes for a specific amino acid sequence. "Regulatory sequences" refer to nucleotide sequences located upstream (5' non-coding sequences), within, or downstream (3' non-coding sequences) of a coding sequence, and which influence the transcription, RNA processing or stability, or translation of the associated coding sequence. Regulatory sequences may include, but are not limited to: promoters, translation leader sequences, introns, polyadenylation recognition sequences, RNA processing sites, effector binding sites and stem-loop structures.

"Promoter" refers to a DNA sequence capable of controlling the expression of a coding sequence or functional RNA. The promoter sequence consists of proximal and more distal upstream elements, the latter elements often referred to as enhancers. Accordingly, an "enhancer" is a DNA sequence that can stimulate promoter activity, and may be an innate element of the promoter or a heterologous element inserted to enhance the level or tissue-specificity of a promoter. Promoters may be derived in their entirety from a native gene, or be composed of different elements derived from different promoters found in nature, or even comprise synthetic DNA segments. It is understood by those skilled in the art that different promoters may direct the expression of a gene in different tissues or cell types, or at different stages of development, or in response to different environmental conditions. It is further recognized that since in most cases the exact boundaries of regulatory sequences have not been completely defined, DNA fragments of some variation may have identical promoter activity. Promoters that cause a gene to be expressed in most cell types at most times are commonly referred to as "constitutive promoters". New promoters of various types useful in plant cells are constantly being discovered; numerous examples may be found in the compilation by Okamuro, J. K., and Goldberg, R. B. *Biochemistry of Plants* 15:1-82 (1989).

"Translation leader sequence" refers to a polynucleotide sequence located between the promoter sequence of a gene and the coding sequence. The translation leader sequence is present in the fully processed mRNA upstream of the translation start sequence. The translation leader sequence may affect processing of the primary transcript to mRNA, mRNA stability or translation efficiency. Examples of translation leader sequences have been described (Turner, R. and Foster, G. D., *Mol. Biotechnol.* 3:225-236 (1995)).

"3' non-coding sequences", "transcription terminator" or "termination sequences" refer to DNA sequences located downstream of a coding sequence, including polyadenylation recognition sequences and other sequences encoding regulatory signals capable of affecting mRNA processing or gene expression. The polyadenylation signal is usually characterized by affecting the addition of polyadenylic acid tracts to the 3' end of the mRNA precursor. The use of different 3' non-coding sequences is exemplified by Ingelbrecht, I. L., et al. *Plant Cell* 1:671-680 (1989).

"RNA transcript" refers to the product resulting from RNA polymerase-catalyzed transcription of a DNA sequence. When the RNA transcript is a perfect complementary copy of the DNA sequence, it is referred to as the primary transcript. An RNA transcript is referred to as the mature RNA when it is an RNA sequence derived from post-transcriptional processing of the primary transcript. "Messenger RNA" or "mRNA" refers to the RNA that is without introns and that can be translated into protein by the cell. "cDNA" refers to a DNA that is complementary to, and synthesized from, an mRNA template using the enzyme reverse transcriptase. The cDNA can be single-stranded or converted into double-stranded form using the Klenow fragment of DNA polymerase I. "Sense" RNA refers to RNA transcript that includes the mRNA and can be translated into protein within a cell or in vitro. "Antisense RNA" refers to an RNA transcript that is complementary to all or part of a target primary transcript or mRNA, and that blocks or reduces the expression of a target gene (U.S. Pat. No. 5,107,065). The complementarity of an antisense RNA may be with any part of the specific gene transcript, i.e., at the 5' non-coding sequence, 3' non-coding sequence, introns, or the coding sequence. "Functional RNA" refers to antisense RNA, ribozyme RNA, or other RNA that may not be translated but yet has an effect on cellular processes. The terms "complement" and "reverse complement" are used interchangeably herein with respect to mRNA transcripts, and are meant to define the antisense RNA of the message.

The term "operably linked" refers to the association of nucleic acid sequences on a single nucleic acid fragment so that the function of one is affected by the other. For example, a promoter is operably linked with a coding sequence when it is capable of affecting the expression of that coding sequence (i.e., the coding sequence is under the transcriptional control of the promoter). Coding sequences can be operably linked to regulatory sequences in a sense or antisense orientation. In another example, the complementary RNA regions of the invention can be operably linked, either directly or indirectly, 5' to the target mRNA, or 3' to the target mRNA, or within the target mRNA, or a first complementary region is 5' and its complement is 3' to the target mRNA.

Standard recombinant DNA and molecular cloning techniques used herein are well known in the art and are described more fully in Sambrook, J., Fritsch, E. F. and Maniatis, T. Molecular Cloning: A Laboratory Manual; Cold Spring Harbor Laboratory: Cold Spring Harbor, N.Y. (1989). Transformation methods are well known to those skilled in the art and are described infra.

"PCR" or "polymerase chain reaction" is a technique for the synthesis of large quantities of specific DNA segments and consists of a series of repetitive cycles (Perkin Elmer Cetus Instruments, Norwalk, Conn.). Typically, the double-stranded DNA is heat denatured, the two primers complementary to the 3' boundaries of the target segment are annealed at low temperature and then extended at an intermediate temperature. One set of these three consecutive steps is referred to as a "cycle".

The term "recombinant" refers to an artificial combination of two otherwise separated segments of sequence, e.g., by chemical synthesis or by the manipulation of isolated segments of nucleic acids by genetic engineering techniques.

A "plasmid" or "vector" is an extra chromosomal element often carrying genes that are not part of the central metabolism of the cell, and usually in the form of circular double-stranded DNA fragments. Such elements may be autonomously replicating sequences, genome integrating sequences, phage or nucleotide sequences, linear or circular, of a single- or double-stranded DNA or RNA, derived from any source, in which a number of nucleotide sequences have been joined or recombined into a unique construction which is capable of introducing an expression cassette(s) into a cell. "Expression cassette" refers to a fragment of DNA containing a foreign gene and having elements in addition to the foreign gene that allow for enhanced expression of that gene in a foreign host. "Transformation cassette" refers to a fragment of DNA containing a foreign gene and having elements in addition to the foreign gene that facilitate transformation of a particular host cell.

The terms "recombinant construct", "expression construct", "chimeric construct", "construct", and "recombinant DNA construct" are used interchangeably herein. A recombinant construct comprises an artificial combination of nucleic acid fragments, e.g., regulatory and coding sequences that are not found together in nature. For example, a recombinant construct may comprise regulatory sequences and coding sequences that are derived from different sources, or regulatory sequences and coding sequences derived from the same source, but arranged in a manner different than that found in nature. Such a construct may be used by itself or may be used in conjunction with a vector. If a vector is used, then the choice of vector is dependent upon the method that will be used to transform host cells as is well known to those skilled in the art. For example, a plasmid vector can be used. The skilled artisan is well aware of the genetic elements that must be present on the vector in order to successfully transform, select and propagate host cells comprising any of the isolated nucleic acid fragments of the invention. The skilled artisan will also recognize that different independent transformation events will result in different levels and patterns of expression (Jones et al., *EMBO J.* 4:2411-2418 (1985); De Almeida et al., *Mol. Gen. Genetics* 218:78-86 (1989)), and thus that multiple events must be screened in order to obtain lines displaying the desired expression level and pattern. Such screening may be accomplished by Southern analysis of DNA, Northern analysis of mRNA expression, immunoblotting analysis of protein expression, or phenotypic analysis, among others.

The term "expression", as used herein, refers to the production of a functional end-product (e.g., an mRNA or a protein [either precursor or mature]).

The term "introduced" means providing a nucleic acid (e.g., expression construct) or protein into a cell. Introduced includes reference to the incorporation of a nucleic acid into a eukaryotic or prokaryotic cell where the nucleic acid may be incorporated into the genome of the cell, and includes reference to the transient provision of a nucleic acid or protein to the cell. Introduced includes reference to stable or transient transformation methods, as well as sexually crossing. Thus, "introduced" in the context of inserting a nucleic acid fragment (e.g., a recombinant construct/expression construct) into a cell, means "transfection" or "transformation" or "transduction" and includes reference to the incorporation of a nucleic acid fragment into a eukaryotic or prokaryotic cell where the nucleic acid fragment may be incorporated into the genome of the cell (e.g., chromosome, plasmid, plastid or mitochondrial DNA), converted into an autonomous replicon, or transiently expressed (e.g., transfected mRNA).

"Mature" protein refers to a post-translationally processed polypeptide (i.e., one from which any pre- or propeptides present in the primary translation product have been removed). "Precursor" protein refers to the primary product of translation of mRNA (i.e., with pre- and propeptides still present). Pre- and propeptides may be but are not limited to intracellular localization signals.

"Stable transformation" refers to the transfer of a nucleic acid fragment into a genome of a host organism, including both nuclear and organellar genomes, resulting in genetically stable inheritance. In contrast, "transient transformation" refers to the transfer of a nucleic acid fragment into the nucleus, or DNA-containing organelle, of a host organism resulting in gene expression without integration or stable inheritance. Host organisms containing the transformed nucleic acid fragments are referred to as "transgenic" organisms.

As used herein, "transgenic" refers to a plant or a cell which comprises within its genome a heterologous polynucleotide. Preferably, the heterologous polynucleotide is stably integrated within the genome such that the polynucleotide is passed on to successive generations. The heterologous polynucleotide may be integrated into the genome alone or as part of an expression construct. Transgenic is used herein to include any cell, cell line, callus, tissue, plant part or plant, the genotype of which has been altered by the presence of heterologous nucleic acid including those transgenics initially so altered as well as those created by sexual crosses or asexual propagation from the initial transgenic. The term "transgenic" as used herein does not encompass the alteration of the genome (chromosomal or extra-chromosomal) by conventional plant breeding methods or by naturally occurring events such as random cross-fertilization, non-recombinant viral infection, non-recombinant bacterial transformation, non-recombinant transposition, or spontaneous mutation.

"Antisense inhibition" refers to the production of antisense RNA transcripts capable of suppressing the expression of the target protein. "Co-suppression" refers to the production of sense RNA transcripts capable of suppressing the expression of identical or substantially similar foreign or endogenous genes (U.S. Pat. No. 5,231,020). Co-suppression constructs in plants previously have been designed by focusing on overexpression of a nucleic acid sequence having homology to an endogenous mRNA, in the sense orientation, which results in the reduction of all RNA having homology to the overexpressed sequence (Vaucheret et al., *Plant J.* 16:651-659 (1998); Gura, *Nature* 404:804-808 (2000)). The overall efficiency of this phenomenon is low, and the extent of the RNA reduction is widely variable. More recent work has described the use of "hairpin" structures that incorporate all, or part, of an mRNA encoding sequence in a complementary orientation that results in a potential "stem-loop" structure for the expressed RNA (PCT Publication No. WO 99/53050; PCT Publication No. WO 02/00904). This increases the frequency of co-suppression in the recovered transgenic plants. Another variation describes the use of plant viral sequences to direct the suppression, or "silencing", of proximal mRNA encoding sequences (PCT Publication No. WO 98/36083). Both of these co-suppressing phenomena have not been elucidated mechanistically, although genetic evidence has begun to unravel this complex situation (Elmayan et al., *Plant Cell* 10:1747-1757 (1998)).

The term "oleaginous" refers to those organisms that tend to store their energy source in the form of lipid (Weete, In: Fungal Lipid Biochemistry, $2^{nd}$ Ed., Plenum, 1980). A class of plants identified as oleaginous are commonly referred to as "oilseed" plants. Examples of oilseed plants include, but are not limited to: soybean (*Glycine* and *Soja* sp.), flax (*Linum* sp.), rapeseed (*Brassica* sp.), maize, cotton, safflower (*Carthamus* sp.) and sunflower (*Helianthus* sp.).

Within oleaginous microorganisms the cellular oil or TAG content generally follows a sigmoid curve, wherein the concentration of lipid increases until it reaches a maximum at the late logarithmic or early stationary growth phase and then gradually decreases during the late stationary and death phases (Yongmanitchai and Ward, *Appl. Environ. Microbiol.* 57:419-25 (1991)). The term "oleaginous yeast" refers to those microorganisms classified as yeasts that make oil. It is not uncommon for oleaginous microorganisms to accumulate in excess of about 25% of their dry cell weight as oil. Examples of oleaginous yeast include, but are no means limited to, the following genera: *Yarrowia, Candida, Rhodotorula, Rhodosporidium, Cryptococcus, Trichosporon* and *Lipomyces.*

As used herein, the term "biomass" refers specifically to spent or used yeast cellular material resulting from the fermentation of a recombinant production host producing PUFAs in commercially significant amounts, wherein the preferred production host is a recombinant strain of the oleaginous yeast, *Yarrowia lipolytica*. The biomass may be in the form of whole cells, whole cell lysates, homogenized cells, partially hydrolyzed cellular material, and/or partially purified cellular material (e.g., microbially produced oil).

The term "Euglenophyceae" refers to a group of unicellular colorless or photosynthetic flagellates ("euglenoids") found living in freshwater, marine, soil, and parasitic environments. The class is characterized by solitary unicells, wherein most are free-swimming and have two flagella (one of which may be nonemergent) arising from an anterior invagination known as a reservoir. Photosynthetic euglenoids contain one to many grass-green chloroplasts, which vary from minute disks to expanded plates or ribbons. Colorless euglenoids depend on osmotrophy or phagotrophy for nutrient assimilation. About 1000 species have been described and classified into about 40 genera and 6 orders. Examples of Euglenophyceae include, but are by no means limited to, the following genera: *Euglena, Eutreptiella* and *Tetruetreptia*.

The term "plant" refers to whole plants, plant organs, plant tissues, seeds, plant cells, seeds and progeny of the same. Plant cells include, without limitation, cells from seeds, suspension cultures, embryos, meristematic regions, callus tissue, leaves, roots, shoots, gametophytes, sporophytes, pollen and microspores.

"Progeny" comprises any subsequent generation of a plant.

An Overview Microbial Biosynthesis of Fatty Acids and Triacylglycerols

In general, lipid accumulation in oleaginous microorganisms is triggered in response to the overall carbon to nitrogen ratio present in the growth medium. This process, leading to the de novo synthesis of free palmitate (16:0) in oleaginous microorganisms, is described in detail in U.S. Pat. No. 7,238, 482. Palmitate is the precursor of longer-chain saturated and unsaturated fatty acid derivates, which are formed through the action of elongases and desaturases (FIG. 1).

TAGs (the primary storage unit for fatty acids) are formed by a series of reactions that involve: (1) the esterification of one molecule of acyl-CoA to glycerol-3-phosphate via an acyltransferase to produce lysophosphatidic acid; (2) the esterification of a second molecule of acyl-CoA via an acyltransferase to yield 1,2-diacylglycerol phosphate (commonly identified as phosphatidic acid); (3) removal of a phosphate by phosphatidic acid phosphatase to yield 1,2-diacylglycerol (DAG); and (4) the addition of a third fatty acid by the action of an acyltransferase to form TAG. A wide spectrum of fatty acids can be incorporated into TAGs, including saturated and unsaturated fatty acids and short-chain and long-chain fatty acids.

Biosynthesis of Omega Fatty Acids

The metabolic process wherein oleic acid is converted to long chain omega-3/omega-6 fatty acids involves elongation of the carbon chain through the addition of carbon atoms and desaturation of the molecule through the addition of double bonds. This requires a series of special desaturation and elongation enzymes present in the endoplasmic reticulum membrane. However, as seen in FIG. 1 and as described below, there are often multiple alternate pathways for production of a specific long chain omega-3/omega-6 fatty acid.

Specifically, all pathways require the initial conversion of oleic acid to LA, the first of the omega-6 fatty acids, by a delta-12 desaturase. Then, using the "delta-9 elongase/delta-8 desaturase pathway" and LA as substrate, long chain omega-6 fatty acids are formed as follows: (1) LA is converted to EDA by a delta-9 elongase; (2) EDA is converted to DGLA by a delta-8 desaturase; (3) DGLA is converted to ARA by a delta-5 desaturase; (4) ARA is converted to DTA by a $C_{20/22}$ elongase; and, (5) DTA is converted to DPAn-6 by a delta-4 desaturase. Alternatively, the "delta-9 elongase/delta-8 desaturase pathway" can use ALA as substrate to produce long chain omega-3 fatty acids as follows: (1) LA is converted to ALA, the first of the omega-3 fatty acids, by a delta-15 desaturase; (2) ALA is converted to ETrA by a delta-9 elongase; (3) ETrA is converted to ETA by a delta-8 desaturase; (4) ETA is converted to EPA by a delta-5 desaturase; (5) EPA is converted to DPA by a $C_{20/22}$ elongase; and (6) DPA is converted to DHA by a delta-4 desaturase. Optionally, omega-6 fatty acids may be converted to omega-3 fatty acids; for example, ETA and EPA are produced from DGLA and ARA, respectively, by delta-17 desaturase activity.

Alternate pathways for the biosynthesis of omega-3/omega-6 fatty acids utilize a delta-6 desaturase and $C_{18/20}$ elongase (also known as delta-6 elongase, the terms can be used interchangeably) (i.e., the "delta-6 desaturase/delta-6 elongase pathway"). More specifically, LA and ALA may be converted to GLA and STA, respectively, by a delta-6 desaturase; then, a $C_{18/20}$ elongase converts GLA to DGLA and/or STA to ETA.

It is contemplated that the particular functionalities required to be introduced into a specific host organism for production of omega-3/omega-6 fatty acids will depend on the host cell (and its native PUFA profile and/or desaturase/elongase profile), the availability of substrate, and the desired end product(s). For example, expression of the delta-9 elongase/delta-8 desaturase pathway may be preferred in some embodiments, as opposed to expression of the delta-6 desaturase/delta-6 elongase pathway, since PUFAs produced via the former pathway are devoid of GLA.

One skilled in the art will be able to identify various candidate genes encoding each of the enzymes desired for omega-3/omega-6 fatty acid biosynthesis. Useful desaturase and elongase sequences may be derived from any source, e.g., isolated from a natural source (from bacteria, algae, fungi, plants, animals, etc.), produced via a semi-synthetic route or synthesized de novo. Although the particular source of the desaturase and elongase genes introduced into the host is not critical, considerations for choosing a specific polypeptide having desaturase or elongase activity include: (1) the substrate specificity of the polypeptide; (2) whether the polypeptide or a component thereof is a rate-limiting enzyme; (3) whether the desaturase or elongase is essential for synthesis of a desired PUFA; (4) co-factors required by the polypeptide; and/or, (5) whether the polypeptide is modified after its production (e.g., by a kinase or a prenyltransferase). The expressed polypeptide preferably has parameters compatible with the biochemical environment of its location in the host cell (see U.S. Pat. No. 7,238,482 for additional details).

In additional embodiments, it will also be useful to consider the conversion efficiency of each particular desaturase and/or elongase. More specifically, since each enzyme rarely functions with 100% efficiency to convert substrate to product, the final lipid profile of unpurified oils produced in a host cell will typically be a mixture of various PUFAs consisting of the desired omega-3/omega-6 fatty acid, as well as various upstream intermediary PUFAs. Thus, each enzyme's conversion efficiency is also a variable to consider when optimizing biosynthesis of a desired fatty acid.

With each of the considerations above in mind, candidate genes having the appropriate desaturase and elongase activities (e.g., delta-6 desaturases, $C_{18/20}$ elongases, delta-5 desaturases, delta-17 desaturases, delta-15 desaturases, delta-9 desaturases, delta-12 desaturases, $C_{14/16}$ elongases, $C_{16/18}$ elongases, delta-9 elongases, delta-8 desaturases, delta-4 desaturases, $C_{20/22}$ elongases and DHA synthases) can be identified according to publicly available literature (e.g., GenBank), the patent literature, and experimental analysis of organisms having the ability to produce PUFAS. These genes will be suitable for introduction into a specific host organism, to enable or enhance the organism's synthesis of PUFAs.

Multizymes and Linkers

In one embodiment, the present invention concerns a multizyme comprising a single polypeptide having at least two independent and separable enzymatic activities Examples of suitable enzymatic activities include elongases, fatty acid desaturases, transferases, acyl CoA synthases and thioesterases. For example, suitable fatty acid desaturases include, but are not limited to: delta-4 desaturase, delta-5 desaturase, delta-6 desaturase, delta-8 desaturase, delta-9 desaturase, delta-12 desaturase, delta-15 desaturase, and/or delta-17 desaturase. Examples of suitable elongases include, but are not limited to: delta-9 elongase, $C_{14/16}$ elongase, $C_{16/18}$ elongase, $C_{18/20}$ elongase, and/or $C_{20/22}$ elongase.

Examples of suitable transferases include but are not limited to acyl transferases such as glycerol-3-phosphate O-acyl transferase (also called glycerol-phosphate acyl transferase or glycerol-3-phosphate acyl transferase; GPAT), 2-acylglycerol O-acyltransferase, 1-acylglycerol-3-phosphate O-acyltransferase (also called 1-acylglycerol-phosphate acyltransferase or lyso-phosphatidic acid acyltransferase; AGPAT or LPAAT or LPAT), 2-acylglycerol-3-phosphate O-acyltransferase, 1-acylglycerophosphocholine O-acyltransferase (also called lyso-lecithin acyltransferase or lyso-phosphatidylcholine acyltransferase; AGPCAT or LLAT or LPCAT), 2-acylglycerophosphocholine O-acyltransferase, diacylglycerol O-acyltransferase (also called diglyceride acyltransferase; DAGAT or DGAT) and phospholipid:diacylglycerol acyltransferase (PDAT).

An example of a suitable acyl CoA synthetase includes but is not limited to long-chain-fatty-acid-CoA ligase (also called acyl-activating enzyme or acyl-CoA synthetase).

An example of a suitable thioesterase includes but is not limited to oleoyl-[acyl-carrier-protein] hydrolase (also called acyl-[acyl-carrier-protein] hydrolase, acyl-ACP-hydrolase or acyl-ACP-thioesterase).

Preferably, the instant multizyme should have enzymatic activities comprising at least one fatty acid elongase linked to at least one fatty acid desaturase.

The link used to form the multizyme is minimally comprised of a single polypeptide bond. In another aspect, the link may be comprised of one amino acid residue, such as proline, or a polypeptide. It may be desirable that if the link is a polypeptide then it has at least one proline amino acid residue.

Preferably, the multizyme of the invention comprises a first enzymatic activity linked to a second enzymatic activity and the link is selected from the group consisting of a polypeptide bond, SEQ ID NO:198 (EgDHAsyn1 linker), SEQ ID NO:200 (EgDHAsyn2 linker), SEQ ID NO:235 (EaDHAsyn1 linker), SEQ ID NO:472, SEQ ID NO:504, and modified *Yarrowia lipolytica* linkers (SEQ ID NOs:438 and 445).

Also within the scope of this invention is a method for making a multizyme which comprises:
  (a) linking a first polypeptide with at least a second polypeptide wherein each polypeptide has an independent and separable enzymatic activity; and
  (b) evaluating the product of step (a) for the independent and separable enzymatic activities.

As was discussed above, the enzymatic activities are selected from the group consisting of fatty acid elongases, fatty acid desaturases, acyl transferases, acyl CoA synthases and thioesterases. Preferably, the enzymatic activities comprise at least one fatty acid elongase linked to at least one fatty acid desaturase.

Examples of suitable desaturases, elongases and linkers are discussed above.

Although numerous examples of multizymes are described above, DHA synthases (comprising both C20 elongase activity and delta-4 desaturase activity) and DGLA synthases (comprising both delta-9 elongase and delta-8 desaturase activity) are of particular interest. Data described herein confirm that linking of the two domains within each synthase results in increased efficiency or flux, as compared to efficiency or flux observed when the enzymatic domains exist as independent entities, i.e., not linked together in a multizyme.

For example, when a mulltizyme comprising the *Euglena gracilis* C20 elongase domain and a *Schizochytrium aggregatum* delta-4 desaturase was expressed in *Yarrowia lipolytica*, the delta-4 desaturase activity was approximately 2 to 3-fold greater in the fused construct, as opposed to its activity when expressed alone (Example 28). Similarly, when the *Euglena gracilis* C20 elongase domain-*Schizochytrium aggregatum* delta-4 desaturase fusion was expressed as a multizyme in soybean, increased EPA to DHA flux was measured, as opposed to when the two enzymes were expressed independently (Example 49).

Increased efficiency (or LA to DGLA flux) was also demonstrated in various DGLA synthases that were created. A series of six delta-9 elongase/delta-8 desaturase fusion constructs were created using various combinations of delta-9 elongases derived from E. gracillis, E. anabaena UTEX 373 and Eutreptiella sp. CCMP389 and delta-8 desaturases derived from E. gracillis and E. anabaena UTEX 373; these were individually expressed in Yarrowia lipolytica (Examples 55 and 56, respectively). In all cases, the fusion gene had higher activity than the individual gene alone when expressed in Yarrowia. These data again suggested that the product of delta-9 elongase may be directly channeled as substrate of delta-8 desaturase in the fusion protein. One skilled in the art would be able to use the teachings herein to create various other multizymes that have increased efficiency or flux. Accordingly, the invention relates to any multizyme that is made using a linker derived from the sequences of the invention. Preferred multizymes are those that combine various genes of the PUFA biosynthetic pathway.

Sequence Identification of Novel DHA Synthases

In the present invention, nucleotide sequences encoding DHA synthases have been isolated from Euglena gracilis and Euglena anabaena, as summarized below in Table 4.

TABLE 4

Summary Of Euglena DHA Synthases

| DHA Synthase Designation | Organism | Nucleotide SEQ ID NO | Amino Acid SEQ ID NO |
| --- | --- | --- | --- |
| EgDHAsyn1 | E. gracilis | 11 | 12 |
| EgDHAsyn1* | E. gracilis | 205 | 12 |
| EgDHAsyn2 | E. gracilis | 21 | 22 |
| EaDHAsyn1 | E. anabaena | 91 | 95 |
| EaDHAsyn2 | E. anabaena | 92 | 96 |
| EaDHAsyn3 | E. anabaena | 93 | 97 |
| EgDHAsyn1S (codon-optimized for Yarrowia expression) | Synthetically derived from E. gracilis EgDHAsyn1 | 410 | 411 (identical to SEQ ID NO: 12) |

In some embodiments, the instant EgDHAsyn1, EgDHAsyn2, EaDHAsyn1, EaDHAsyn2 and EaDHAsyn3 DHA synthase sequences can be codon-optimized for expression in a particular host organism. As is well known in the art, this can be a useful means to further optimize the expression of the enzyme in the alternate host, since use of host-preferred codons can substantially enhance the expression of the foreign gene encoding the polypeptide. EgDHAsyn1, for example, was codon-optimized for expression in Yarrowia lipolytica (example 54), thereby yielding EgDHAsyn1S (as taught in U.S. Pat. No. 7,238,482 and U.S. Pat. No. 7,125,672).

One skilled in the art would be able to use the teachings herein to create various other codon-optimized DHA synthase proteins suitable for optimal expression in alternate hosts, based on the wildtype EgDHAsyn1, EgDHAsyn2, EaDHAsyn1, EaDHAsyn2 and/or EaDHAsyn3 sequences described above in Table 4. Accordingly, the instant invention relates to any codon-optimized DHA synthase protein that is derived from a wildtype sequence of the instant invention. In some preferred embodiments, it may be desirable to modify a portion of the codons encoding EgDHAsyn1, EgDHAsyn2, EaDHAsyn1, EaDHAsyn2 and/or EaDHAsyn3 to enhance expression of the gene in a host organism including, but not limited to, a plant or plant part.

In another embodiment, the present invention concerns an isolated polynucleotide encoding a DHA synthase comprising:

(a) a nucleotide sequence encoding a polypeptide having DHA synthase activity, wherein the polypeptide has at least 80% amino acid identity, based on the Clustal V method of alignment, when compared to an amino acid sequence as set forth in SEQ ID NO:12, SEQ ID NO:22, SEQ ID NO:95, SEQ ID NO:96, or SEQ ID NO:97;

(b) a nucleotide sequence encoding a polypeptide having DHA synthase activity wherein the nucleotide sequence has at least 80% sequence identity, based on the BLASTN method of alignment, when compared to a nucleotide sequence as set forth in SEQ ID NO:11, SEQ ID NO:205, SEQ ID NO:21, SEQ ID NO:91, SEQ ID NO:92, SEQ ID NO:93, or SEQ ID NO:410;

(c) a nucleotide sequence encoding a polypeptide having DHA synthase activity, wherein the nucleotide sequence hybridizes under stringent conditions to a nucleotide sequence as set forth in SEQ ID NO:11, SEQ ID NO:21, SEQ ID NO:91, SEQ ID NO:92, SEQ ID NO:93, SEQ ID NO:205, or SEQ ID NO:410; or (d) a complement of the nucleotide sequence of (a), (b) or (c), wherein the complement and the nucleotide sequence consist of the same number of nucleotides and are 100% complementary.

In still another aspect, this invention concerns an isolated polynucleotide comprising:

(a) a nucleotide sequence encoding a polypeptide having DHA synthase activity, wherein the polypeptide has at least 80% amino acid identity, based on the Clustal V method of alignment, when compared to an amino acid sequence as set forth in SEQ ID NO:12, SEQ ID NO:22, SEQ ID NO:95, SEQ ID NO:96, SEQ ID NO:97, or SEQ ID NO:411;

(b) a nucleotide sequence encoding a polypeptide having DHA synthase activity wherein the nucleotide sequence has at least 80% sequence identity, based on the BLASTN method of alignment, when compared to a nucleotide sequence as set forth in SEQ ID NO:11, SEQ ID NO:205, SEQ ID NO:21, SEQ ID NO:91, SEQ ID NO:92, SEQ ID NO:93 or SEQ ID NO:410;

(c) a nucleotide sequence encoding a polypeptide having DHA synthase activity, wherein the nucleotide sequence hybridizes under stringent conditions to a nucleotide sequence as set forth in SEQ ID NO:11, SEQ ID NO:205, SEQ ID NO:21, SEQ ID NO:91, SEQ ID NO:92, SEQ ID NO:93 or SEQ ID NO:410; or (d) a complement of the nucleotide sequence of (a), (b) or (c), wherein the complement and the nucleotide sequence consist of the same number of nucleotides and are 100% complementary.

Preferably, an isolated polynucleotide encoding a DHA synthase comprises the sequence set forth in any of SEQ ID NO:11, SEQ ID NO:205, SEQ ID NO:21, SEQ ID NO:91, SEQ ID NO:92, SEQ ID NO:93, or SEQ ID NO:410.

Identification and Isolation of Homologs

Any of the instant DHA synthase sequences (i.e., EgDHAsyn1, EgDHAsyn2, EaDHAsyn1, EaDHAsyn2 and EaDHAsyn3) or portions thereof may be used to search for DHA synthase homologs in the same or other bacterial, algal, fungal, euglenoid or plant species using sequence analysis software. In general, such computer software matches similar sequences by assigning degrees of homology to various substitutions, deletions, and other modifications.

Alternatively, any of the instant DHA synthase sequences or portions thereof may also be employed as hybridization reagents for the identification of DHA synthase homologs. The basic components of a nucleic acid hybridization test include a probe, a sample suspected of containing the gene or gene fragment of interest and a specific hybridization method. Probes of the present invention are typically single-stranded nucleic acid sequences that are complementary to the nucleic acid sequences to be detected. Probes are "hybridizable" to the nucleic acid sequence to be detected. Although the probe length can vary from 5 bases to tens of thousands of bases, typically a probe length of about 15 bases to about 30 bases is suitable. Only part of the probe molecule needs to be complementary to the nucleic acid sequence to be detected. In addition, the complementarity between the probe and the target sequence need not be perfect. Hybridization does occur between imperfectly complementary molecules with the result that a certain fraction of the bases in the hybridized region are not paired with the proper complementary base.

Hybridization methods are well defined. Typically the probe and sample must be mixed under conditions that will permit nucleic acid hybridization. This involves contacting the probe and sample in the presence of an inorganic or organic salt under the proper concentration and temperature conditions. The probe and sample nucleic acids must be in contact for a long enough time that any possible hybridization between the probe and sample nucleic acid may occur. The concentration of probe or target in the mixture will determine the time necessary for hybridization to occur. The higher the probe or target concentration, the shorter the hybridization incubation time needed. Optionally, a chaotropic agent may be added (e.g., guanidinium chloride, guanidinium thiocyanate, sodium thiocyanate, lithium tetrachloroacetate, sodium perchlorate, rubidium tetrachloroacetate, potassium iodide, cesium trifluoroacetate). If desired, one can add formamide to the hybridization mixture, typically 30-50% (v/v).

Various hybridization solutions can be employed. Typically, these comprise from about 20 to 60% volume, preferably 30%, of a polar organic solvent. A common hybridization solution employs about 30-50% v/v formamide, about 0.15 to 1 M sodium chloride, about 0.05 to 0.1 M buffers (e.g., sodium citrate, Tris-HCl, PIPES or HEPES (pH range about 6-9)), about 0.05 to 0.2% detergent (e.g., sodium dodecylsulfate), or between 0.5-20 mM EDTA, FICOLL (Pharmacia Inc.) (about 300-500 kdal), polyvinylpyrrolidone (about 250-500 kdal), and serum albumin. Also included in the typical hybridization solution will be unlabeled carrier nucleic acids from about 0.1 to 5 mg/mL, fragmented nucleic DNA (e.g., calf thymus or salmon sperm DNA, or yeast RNA), and optionally from about 0.5 to 2% wt/vol glycine. Other additives may also be included, such as volume exclusion agents that include a variety of polar water-soluble or swellable agents (e.g., polyethylene glycol), anionic polymers (e.g., polyacrylate or polymethylacrylate) and anionic saccharidic polymers (e.g., dextran sulfate).

Nucleic acid hybridization is adaptable to a variety of assay formats. One of the most suitable is the sandwich assay format. The sandwich assay is particularly adaptable to hybridization under non-denaturing conditions. A primary component of a sandwich-type assay is a solid support. The solid support has adsorbed to it or covalently coupled to it an immobilized nucleic acid probe that is unlabeled and complementary to one portion of the sequence.

In additional embodiments, any of the DHA synthase nucleic acid fragments described herein (or any homologs identified thereof) may be used to isolate genes encoding homologous proteins from the same or other bacterial, algal, fungal, euglenoid or plant species. Isolation of homologous genes using sequence-dependent protocols is well known in the art. Examples of sequence-dependent protocols include, but are not limited to: (1) methods of nucleic acid hybridization; (2) methods of DNA and RNA amplification, as exemplified by various uses of nucleic acid amplification technologies [e.g., polymerase chain reaction (PCR), Mullis et al., U.S. Pat. No. 4,683,202; ligase chain reaction (LCR), Tabor et al., Proc. Acad. Sci. USA 82:1074 (1985); or strand displacement amplification (SDA), Walker et al., Proc. Natl. Acad. Sci. U.S.A., 89:392 (1992)]; and (3) methods of library construction and screening by complementation.

For example, genes encoding similar proteins or polypeptides to a multizyme or an individual domain thereof (such as the DHA synthases) described herein, could be isolated directly by using all or a portion of the instant nucleic acid fragments as DNA hybridization probes to screen libraries from e.g., any desired yeast or fungus using methodology well known to those skilled in the art (wherein those organisms producing DTA, DPAn-6, DPA and/or DHA would be preferred). Specific oligonucleotide probes based upon the instant nucleic acid sequences can be designed and synthesized by methods known in the art (Maniatis, supra). Moreover, the entire sequences can be used directly to synthesize DNA probes by methods known to the skilled artisan (e.g., random primers DNA labeling, nick translation or end-labeling techniques), or RNA probes using available in vitro transcription systems. In addition, specific primers can be designed and used to amplify a part of (or full-length of) the instant sequences. The resulting amplification products can be labeled directly during amplification reactions or labeled after amplification reactions, and used as probes to isolate full-length DNA fragments under conditions of appropriate stringency.

Typically, in PCR-type amplification techniques, the primers have different sequences and are not complementary to each other. Depending on the desired test conditions, the sequences of the primers should be designed to provide for both efficient and faithful replication of the target nucleic acid. Methods of PCR primer design are common and well known in the art (Thein and Wallace, "The use of oligonucleotide as specific hybridization probes in the Diagnosis of Genetic Disorders", in *Human Genetic Diseases: A Practical Approach*, K. E. Davis Ed., (1986) pp 33-50, IRL: Herndon, Va.; and Rychlik, W., In *Methods in Molecular Biology*, White, B. A. Ed., (1993) Vol. 15, pp 31-39, PCR Protocols: Current Methods and Applications. Humania: Totowa, N.J.).

Generally two short segments of the instant sequences may be used in PCR protocols to amplify longer nucleic acid fragments encoding homologous genes from DNA or RNA. PCR may also be performed on a library of cloned nucleic acid fragments wherein the sequence of one primer is derived from the instant nucleic acid fragments, and the sequence of the other primer takes advantage of the presence of the polyadenylic acid tracts to the 3' end of the mRNA precursor encoding eukaryotic genes.

Alternatively, the second primer sequence may be based upon sequences derived from the cloning vector. For example, the skilled artisan can follow the RACE protocol (Frohman et al., *Proc. Natl Acad. Sci. U.S.A.*, 85:8998 (1988)) to generate cDNAs by using PCR to amplify copies of the region between a single point in the transcript and the 3' or 5' end. Primers oriented in the 3' and 5' directions can be designed from the instant sequences. Using commercially available 3' RACE or 5' RACE systems (Gibco/BRL, Gaithersburg, Md.), specific 3' or 5' cDNA fragments can be isolated (Ohara et al., *Proc. Natl. Acad. Sci. U.S.A.*, 86:5673 (1989); Loh et al., *Science* 243:217 (1989)).

In other embodiments, any of the enzymes (e.g., multizymes, DHA synthases, or individual domains described herein) may be modified. As is well known to those skilled in the art, in vitro mutagenesis and selection, chemical mutagenesis, "gene shuffling" methods or other means can be employed to obtain mutations of naturally occurring genes. Alternatively, multizymes may be synthesized by domain swapping, wherein a functional domain from any enzyme may be exchanged with or added to a functional domain in an alternate enzyme to thereby result in a novel protein.

Sequence Identification of Novel C20 Elongases

In the present invention, nucleotide sequences encoding C20 elongases have been isolated from *Euglena gracilis* and *Euglena anabaena*, as summarized below in Table 5.

TABLE 5

Summary Of *Euglena* C20 Elongases

| C20 Elongase Designation | Organism | Nucleotide SEQ ID NO | Amino Acid SEQ ID NO |
|---|---|---|---|
| EgDHAsyn1 C20 elongase domain | *E. gracilis* | 201 | 202 |
| EgDHAsyn1* C20 elongase domain | *E. gracilis* | 206 | — |
| EgDHAsyn2 C20 elongase domain | *E. gracilis* | 203 | 204 |
| EaDHAsyn1 C20 elongase domain | *E. anabaena* | 227 | 231 |
| EaDHAsyn2 C20 elongase domain | *E. anabaena* | 228 | 232 |
| EaDHAsyn3 C20 elongase domain | *E. anabaena* | 229 | 233 |
| EaDHAsyn4 C20 elongase domain | *E. anabaena* | 230 | — |
| EgC20ES C20 elongase domain (codon-optimized for expression in *Yarrowia*) | Synthetically derived from *E. gracilis* EgDHAsyn1 | 183 | 184 (identical to SEQ ID NO: 202) |
| EaC20ES C20 elongase domain (codon-optimized for expression in *Yarrowia*) | Synthetically derived from *E. anabaena* EaDHAsyn2 | 188 | 189 (identical to SEQ ID NO: 232) |

The instant invention concerns an isolated polynucleotide encoding a C20 elongase comprising:
  (a) a nucleotide sequence encoding a polypeptide having C20 elongase activity, wherein the polypeptide has at least 80% amino acid identity, based on the Clustal V method of alignment, when compared to an amino acid sequence as set forth in SEQ ID NO:12, SEQ ID NO:22, SEQ ID NO:95, SEQ ID NO:96, SEQ ID NO:97; SEQ ID NO:202, SEQ ID NO:204, SEQ ID NO:231, SEQ ID NO:232, or SEQ ID NO:233;
  (b) a nucleotide sequence encoding a polypeptide having C20 elongase activity wherein the nucleotide sequence has at least 80% sequence identity, based on the BLASTN method of alignment, when compared to a nucleotide sequence as set forth in SEQ ID NO:11, SEQ ID NO:21, SEQ ID NO:91, SEQ ID NO:92, SEQ ID NO:93, SEQ ID NO:183, SEQ ID NO:188, SEQ ID NO:201, SEQ ID NO:206, SEQ ID NO:203, SEQ ID NO:227, SEQ ID NO:228, SEQ ID NO:229, or SEQ ID NO:230;
  (c) a nucleotide sequence encoding a polypeptide having C20 elongase activity, wherein the nucleotide sequence hybridizes under stringent conditions to a nucleotide sequence as set forth in SEQ ID NO:11, SEQ ID NO:21, SEQ ID NO:91, SEQ ID NO:92, SEQ ID NO:93, SEQ ID NO:183, SEQ ID NO:188, SEQ ID NO:201, SEQ ID NO:206, SEQ ID NO:203, SEQ ID NO:227, SEQ ID NO:228, SEQ ID NO:229, SEQ ID NO:230; or
  (d) a complement of the nucleotide sequence of (a), (b) or (c), wherein the complement and the nucleotide sequence consist of the same number of nucleotides and are 100% complementary.

Preferably, an isolated polynucleotide encoding a C20 elongase, comprises the sequence set forth in any of SEQ ID NO:183, SEQ ID NO:188, SEQ ID NO:201, SEQ ID NO:206, SEQ ID NO:203, SEQ ID NO:227, SEQ ID NO:228, SEQ ID NO:229, or SEQ ID NO:230.

Sequence Identification of Novel Delta-4 Desaturases

In the present invention, nucleotide sequences encoding delta-4 desaturases have been isolated from *Euglena gracilis* and *Euglena anabaena*, as summarized below in Table 6.

TABLE 6

Summary Of *Euglena* Delta-4 Desaturases

| Delta-4 Desaturase Designation* | Organism | Nucleotide SEQ ID NO | Amino Acid SEQ ID NO |
|---|---|---|---|
| EgDHAsyn1 delta-4 desaturase domain 1 | *E. gracilis* | 214 | 215 |
| EgDHAsyn1 delta-4 desaturase domain 1* | Synthetically derived from *E. gracilis* EgDHAsyn1 | 216 | 217 |
| EgDHAsyn1* delta-4 desaturase domain 2 | *E. gracilis* | 220 | 221 |
| EaDHAsyn1 delta-4 desaturase domain 1 | *E. anabaena* | 236 | 239 |
| EaDHAsyn2 delta-4 desaturase domain 1 | *E. anabaena* | 237 | 240 |
| EaDHAsyn4 delta-4 desaturase domain 1 | *E. anabaena* | 238 | 241 |
| EaDHAsyn1 delta-4 desaturase domain 2 | *E. anabaena* | 242 | 246 |
| EaDHAsyn2 delta-4 desaturase domain 2 | *E. anabaena* | 243 | 247 |
| EaDHAsyn3 delta-4 desaturase domain 2 | *E. anabaena* | 244 | 248 |
| EaDHAsyn4 delta-4 desaturase domain 2 | *E. anabaena* | 245 | 249 |
| EaD4S delta-4 desaturase domain (codon-optimized for expression in *Yarrowia*) | Synthetically derived from *E. anabaena* EaDHAsyn2 | 192 | 193 |
| EgD4S delta-4 desaturase domain (codon-optimized for expression in *Yarrowia*) | Synthetically derived from *E. gracilis* EgDHAsyn1 | 387 | 388 |

*Note: The delta-4 desaturase domain 1 does not include the proline-rich linker of the DHA synthase from which it was derived. In contrast, the delta-4 desaturase domain 2 does include the proline-rich linker of the DHA synthase from which it was derived.

In alternate embodiments, the instant delta-4 desaturase domain sequences can be codon-optimized for expression in a particular host organism. For example, the *Euglena anabaena* delta-4 desaturase domain of EaDHAsyn2 was codon-optimized for expression in *Yarrowia lipolytica*. For example, the *Euglena gracilis* delta-4 desaturase domain of EgDHAsyn1 was also codon-optimized for expression in *Yarrowia lipolytica* One skilled in the art would be able to use the teachings herein to create various other codon-optimized delta-4 desaturase proteins suitable for optimal expression in alternate hosts, based on the wildtype delta-4 desaturase domain sequences of EgDHAsyn1, EgDHAsyn2, EaDHAsyn1, EaDHAsyn2 and/or EaDHAsyn3 as described above in Table 6. Accordingly, the instant invention relates to any codon-optimized delta-4 desaturase protein that is derived from a wildtype sequence of the instant invention. In some preferred embodiments, it may be desirable to modify a portion of the codons encoding the delta-4 desaturase domain sequences of EgDHAsyn1, EgDHAsyn2, EaDHAsyn1, EaDHAsyn2 and/or EaDHAsyn3 to enhance expression of the gene in a host organism including, but not limited to, a plant or plant part.

Moreover, based on the observation that the C-terminal portion of the C20 elongase domain of the DHA synthases appears to overlap with the N-terminal portion of the delta-4 desaturase domain, functional analyses were performed to define the optimal functional delta-4 desaturase domain. As described in Examples 51 and 53 hereinbelow, deletion mutagenesis studies were performed using the codon-optimized protein sequences, EaD4S (SEQ ID NO:193) and EgD4S (SEQ ID NO:388). The following variants were produced: EaD4S-3 (SEQ ID NO:386), EaD4S-2 (SEQ ID NO:384), EaD4S-1 (SEQ ID NO:382), EgD4S-3 (SEQ ID NO:408), EgD4S-2 (SEQ ID NO:406) and EgD4S-1 (SEQ ID NO:404).

One skilled in the art will recognize that since the exact boundaries of these particular delta-4 desaturase sequences from *Euglena gracilis* and *Euglena anabaena* have not been completely defined, protein fragments or polypeptides of increased or diminished lengths may have comparable delta-4 desaturase activity. Similarly, comparable truncations could readily be performed based on the wildtype delta-4 desaturase domain sequences of EgDHAsyn1, EgDHAsyn2, EaDHAsyn1, EaDHAsyn2 and/or EaDHAsyn3 as described above in Table 6, to produce a delta-4 desaturase having a sufficient amount of delta-4 desaturase activity, wherein equivalent or increased delta-4 desaturase activity would be preferred.

Thus, the instant invention further concerns an isolated polynucleotide encoding a delta-4 desaturase comprising:

(a) a nucleotide sequence encoding a polypeptide having delta-4 desaturase activity, wherein the polypeptide has at least 80% amino acid identity, based on the Clustal V method of alignment, when compared to an amino acid sequence as set forth in SEQ ID NO:12, SEQ ID NO:22, SEQ ID NO:95, SEQ ID NO:96, SEQ ID NO:97, SEQ ID NO:215, SEQ ID NO:217, SEQ ID NO:221, SEQ ID NO:239, SEQ ID NO:240, SEQ ID NO:241, SEQ ID NO:246, SEQ ID NO:247, SEQ ID NO:248, SEQ ID NO:249, SEQ ID NO:193, SEQ ID NO:382, SEQ ID NO:384, SEQ ID NO:386, SEQ ID NO:388, SEQ ID NO:404, SEQ ID NO:406, or SEQ ID NO:408;

(b) a nucleotide sequence encoding a polypeptide having delta-4 desaturase activity wherein the nucleotide sequence has at least 80% sequence identity, based on the BLASTN method of alignment, when compared to a nucleotide sequence as set forth in SEQ ID NO:11, SEQ ID NO:21, SEQ ID NO:91, SEQ ID NO:92, SEQ ID NO:93, SEQ ID NO:214, SEQ ID NO:216, SEQ ID NO:220, SEQ ID NO:236, SEQ ID NO:237, SEQ ID NO:238, SEQ ID NO:242, SEQ ID NO:243, SEQ ID NO:244, SEQ ID NO:245, SEQ ID NO:192, SEQ ID NO:381, SEQ ID NO:383, SEQ ID NO:385, SEQ ID NO:387, SEQ ID NO:403, SEQ ID NO:405 or SEQ ID NO:407;

(c) a nucleotide sequence encoding a polypeptide having delta-4 desaturase activity, wherein the nucleotide sequence hybridizes under stringent conditions to a nucleotide sequence as set forth in SEQ ID NO:11, SEQ ID NO:21, SEQ ID NO:91, SEQ ID NO:92, SEQ ID NO:93, SEQ ID NO:214, SEQ ID NO:216, SEQ ID NO:220, SEQ ID NO:236, SEQ ID NO:237, SEQ ID NO:238, SEQ ID NO:242, SEQ ID NO:243, SEQ ID NO:244, SEQ ID NO:245, SEQ ID NO:192, SEQ ID NO:381, SEQ ID NO:383, SEQ ID NO:385, SEQ ID NO:387, SEQ ID NO:403, SEQ ID NO:405 or SEQ ID NO:407; or (d) a complement of the nucleotide sequence of (a), (b) or (c), wherein the complement and the nucleotide sequence consist of the same number of nucleotides and are 100% complementary.

Preferably, an isolated polynucleotide encoding a delta-4 desaturase comprises the sequence set forth in any of SEQ ID NO:214, SEQ ID NO:220, SEQ ID NO:236, SEQ ID NO:237, SEQ ID NO:238, SEQ ID NO:242, SEQ ID NO:243, SEQ ID NO:244, SEQ ID NO:245, SEQ ID NO:192, SEQ ID NO:381, SEQ ID NO:383, SEQ ID NO:385, SEQ ID NO:387, SEQ ID NO:403, SEQ ID NO:405, or SEQ ID NO:407.

The effect of truncating the *Euglena anabaena* delta-4 desaturase is that enzymatic activity is increased when compared to enzymatic activity of the wildtype sequence. This result is unexpected and unforeseeable, as one of ordinary skill in the art would expect the activity of a truncated sequence to be no better and possibly less active than the wildtype sequence. Accordingly, the invention also provides a new method for deriving a delta-4 desaturase having higher activity than the wildtype sequence, the method comprising: a) providing a wild-type delta-4 desaturase polypeptide isolated from *Euglena anabena* having a base-line delta-4 desaturase activity; and b) truncating the wild-type polypeptide of (a) by about 1 to about 200 amino acids (a) to create a truncated mutant polypeptide having delta-4 desaturase activity that is increased as compared with the baseline delta-4 desaturase activity. "Baseline" activity as used in this context is defined as the activity of the wildtype enzyme measured either in vivo or in vitro according to standard enzymatic protocols as described herein.

In other embodiments, any of the enzymes (e.g., multizymes, DHA synthases, C20 elongases, delta-4 desaturases, and/or any homologs) identified herein may be modified to generate new and/or improved PUFA biosynthetic pathway enzymes. As is well known to those skilled in the art, in vitro mutagenesis and selection, chemical mutagenesis, "gene shuffling" methods or other means can be employed to obtain mutations of naturally occurring genes. Alternatively, multizymes may be synthesized by domain swapping, wherein a functional domain from any enzyme may be exchanged with or added to a functional domain in an alternate enzyme to thereby result in a novel protein.

Methods for Production of Various Omega-3 and/or Omega-6 Fatty Acids

It is expected that introduction of chimeric genes encoding the DHA synthases described herein (i.e., EgDHAsyn1, EgDHAsyn2, EaDHAsyn1, EaDHAsyn2 and EaDHAsyn3 or other mutant enzymes, codon-optimized enzymes or homologs thereof), under the control of the appropriate promoters will result in increased production of DTA, DPAn-6, DPA and/or DHA in the transformed host organism, respectively. As such, the present invention encompasses a method for the direct production of PUFAs comprising exposing a fatty acid substrate (i.e., EPA or DPA) to the DHA synthase enzymes described herein (e.g., EgDHAsyn1, EgDHAsyn2, EaDHAsyn1, EaDHAsyn2 and EaDHAsyn3), such that the substrate is converted to the desired fatty acid product (i.e., DHA).

More specifically, the present invention concerns a method for transforming a host cell such that the host cell comprises in its genome a recombinant construct of the invention.

Examples of suitable host cells include, but are not limited to, plants and yeast. Preferably, the plant cells are obtained from an oilseed plant such as soybean and the like and yeast cells are obtained from oleaginous yeast such as *Yarrowia* sp.

Also within the scope of this invention is a method for producing a transformed plant or yeast comprising transforming a plant cell or a yeast cell with any of the polynucleotides of the invention and regenerating a plant from the transformed plant cell or growing the transformed yeast cells.

More specifically, it is an object of the present invention to provide a method for the production of DPAn-6 or DHA in a host cell (e.g., plants, oleaginous yeast), wherein the host cell comprises:
(i) an isolated nucleotide molecule encoding a polypeptide having DHA synthase activity, wherein the polypeptide has at least 80% amino acid identity, based on the Clustal V method of alignment, when compared to an amino acid sequence as set forth in SEQ ID NO:12, SEQ ID NO:22, SEQ ID NO:95, SEQ ID NO:96, or SEQ ID NO:97; and,
(ii) a source of ARA or EPA;
wherein the host cell is grown under conditions such that the polypeptide having DHA synthase activity is expressed and the ARA is converted to DPAn-6 and/or the EPA is converted to DHA, and wherein the DPAn-6 or DHA is optionally recovered.

In alternate embodiments, the present invention concerns a method for the production of DTA or DPA in a host cell (e.g., plants, oleaginous yeast), wherein the host cell comprises:
(ii) an isolated nucleotide molecule encoding a polypeptide having C20 elongase activity, wherein the polypeptide has at least 80% amino acid identity, based on the Clustal V method of alignment, when compared to an amino acid sequence as set forth in SEQ ID NO:12, SEQ ID NO:22, SEQ ID NO:95, SEQ ID NO:96, SEQ ID NO:97, SEQ ID NO:202, SEQ ID NO:204, SEQ ID NO:231, SEQ ID NO:232, or SEQ ID NO:233; and,
(ii) a source of ARA or EPA;
wherein the host cell is grown under conditions such that the polypeptide having C20 elongase activity is expressed and the ARA is converted to DTA and/or the EPA is converted to DPA, and wherein the DTA or DPA is optionally recovered.

Additionally, the invention provides a method for the production of DPAn-6 or DHA, wherein the host cell comprises:
(i) an isolated nucleotide molecule encoding a polypeptide having delta-4 desaturase activity, wherein the polypeptide has at least 80% amino acid identity, based on the Clustal V method of alignment, when compared to an amino acid sequence as set forth in SEQ ID NO:12, SEQ ID NO:22, SEQ ID NO:95, SEQ ID NO:96, SEQ ID NO:97, SEQ ID NO:215, SEQ ID NO:221, SEQ ID NO:239, SEQ ID NO:240, SEQ ID NO:241, SEQ ID NO:246, SEQ ID NO:247, SEQ ID NO:248, SEQ ID NO:249, SEQ ID NO:382, SEQ ID NO:384, SEQ ID NO:386, SEQ ID NO:388, SEQ ID NO:404, SEQ ID NO:406, or SEQ ID NO:408; and,
(ii) a source of DTA or DPA;
wherein the host cell is grown under conditions such that the polypeptide having delta-4 desaturase activity is expressed and the DTA is converted to DPAn-6 and/or the DPA is converted to DHA, and wherein the DPAn-6 or DHA is optionally recovered.

The source of the substrate(s) ARA, DTA, EPA or DPA used in any of the methods above may be produced by the host either naturally or transgenically, or may be provided exogenously.

Linking individual domains to form a multizyme could lead to a decrease in intermediate fatty acids. For instance, linking a C20 elongase with a delta-4 desaturase in a multizyme, such as DHA synthase, may lead to a decrease in the intermediate fatty acid DPA during production of DHA. Similarly, linking a delta-9 elongase with a delta-8 desaturase using the EgDHAsyn1 linker to form a multizyme as described herein may lead to the production of DGLA and ETA with a decrease in EDA and ERA intermediates.

Alternatively, each multizyme gene including DHA synthase and their corresponding enzyme products described herein can be used indirectly for the production of various omega-6 and omega-3 PUFAs, including e.g., DTA, DPAn-6, DGLA, ETA, ARA, EPA, DPA and/or DHA (FIG. 1; see U.S. Pat. No. 7,238,482). Indirect production of omega-3/omega-6 PUFAs occurs wherein the fatty acid substrate is converted indirectly into the desired fatty acid product, via means of an intermediate step(s) or pathway intermediate(s). Thus, it is contemplated that the DHA synthases described herein (i.e., EgDHAsyn1, EgDHAsyn2, EaDHAsyn1, EaDHAsyn2 and EaDHAsyn3, or other mutant enzymes, codon-optimized enzymes or homologs thereof) may be expressed in conjunction with additional genes encoding enzymes of the PUFA biosynthetic pathway (e.g., delta-6 desaturases, $C_{18/20}$ elongases, delta-17 desaturases, delta-8 desaturases, delta-15 desaturases, delta-9 desaturases, delta-12 desaturases, $C_{14/16}$ elongases, $C_{16/18}$ elongases, delta-9 elongases, delta-5 desaturases, delta-4 desaturases, $C_{20/22}$ elongases, DHA synthases) to result in higher levels of production of longer-chain omega-3/omega-6 fatty acids (e.g., ARA, DTA, DPAn-6, EPA, DPA and/or DHA).

The specific genes included within a particular expression cassette will depend on the host cell (and its PUFA profile and/or desaturase/elongase profile), the availability of substrate and the desired end product(s).

At times, it may be desirable to minimize by-product fatty acids. The relative abundance of by-product fatty acids could be decreased by linking individual pathway enzymes together with a linker to form a multizyme. For instance, the presence of sciadonic acid (SCI) and/or juniperonic acid (JUP) [commonly found in the seed lipids of gymnosperms (Wolff et al., *Lipids* 35(1):1-22 (2000)), such as those in the *Pinaceae* family (pine)] might be considered by-product fatty acids of a delta-6 desaturase/delta-6 elongase pathway or delta-9-elongase/delta-8 desaturase pathway. Although these fatty acids are considered to have various health-enhancing properties themselves (Nakane et al., *Biol. Pharm. Bull.* 23: 758-761 (2000)), their presence as by-product fatty acids in an engineered PUFA pathway, such as in an oilseed crop, may not be desirable depending on the application. Linking a delta-9 elongase together with a delta-8 desaturase using a linker to form a multizyme (DGLA and/or ETA synthase), for example, could result in increased flux through these steps leading to reduced availability of the EDA/ERA intermediate fatty acids to delta-5 desaturase, and thus reduced concentrations of SCI and JUP.

Occasionally, a delta-6 elongase may elongate fatty acids other than the intended fatty acid. For instance, delta-6 elongases generally convert GLA to DGLA but some delta-6 elongases may also convert unintended substrates such as LA or ALA to EDA or ETrA, respectively. In a delta-6 desaturase/delta-6 elongase pathway, EDA and ETrA would be considered "by-product fatty acids". Addition of a delta-8 desaturase to a delta-6 desaturase/delta-6 elongase pathway may provide a means to convert the "by-product fatty acids" EDA and ETrA back into the "intermediate fatty acids" DGLA and ETA, respectively.

In alternative embodiments, it may be useful to disrupt a host organism's native DHA synthase, C20 elongase, or delta-4 desaturase, based on the complete sequences described herein, the complement of those complete sequences, substantial portions of those sequences, codon-optimized desaturases derived therefrom, and those sequences that are substantially homologous thereto.

Plant Expression Systems, Cassettes and Vectors, and Transformation

In one embodiment, this invention concerns a recombinant construct comprising any one of the isolated polynucleotides of the invention operably linked to at least one regulatory sequence suitable for expression in a host cell such as a plant. A promoter is a DNA sequence that directs cellular machinery of a plant to produce RNA from the contiguous coding sequence downstream (3') of the promoter. The promoter region influences the rate, developmental stage, and cell type in which the RNA transcript of the gene is made. The RNA transcript is processed to produce mRNA which serves as a template for translation of the RNA sequence into the amino acid sequence of the encoded polypeptide. The 5' non-translated leader sequence is a region of the mRNA upstream of the protein coding region that may play a role in initiation and translation of the mRNA. The 3' transcription termination/polyadenylation signal is a non-translated region downstream of the protein coding region that functions in the plant cell to cause termination of the RNA transcript and the addition of polyadenylate nucleotides to the 3' end of the RNA.

The origin of the promoter chosen to drive expression of the multizyme coding sequence is not important as long as it has sufficient transcriptional activity to accomplish the invention by expressing translatable mRNA for the desired nucleic acid fragments in the desired host tissue at the right time. Either heterologous or non-heterologous (i.e., endogenous) promoters can be used to practice the invention. For example, suitable promoters in plants include, but are not limited to: the alpha prime subunit of beta conglycinin promoter, the Kunitz trypsin inhibitor 3 promoter, the annexin promoter, the glycinin Gy1 promoter, the beta subunit of beta conglycinin promoter, the P34/Gly Bd m 30K promoter, the albumin promoter, the Leg A1 promoter and the Leg A2 promoter.

The annexin, or P34, promoter is described in PCT Publication No. WO 2004/071178 (published Aug. 26, 2004). The level of activity of the annexin promoter is comparable to that of many known strong promoters, such as: (1) the CaMV 35S promoter (Atanassova et al., *Plant Mol. Biol.* 37:275-285 (1998); Battraw and Hall, *Plant Mol. Biol.* 15:527-538 (1990); Holtorf et al., *Plant Mol. Biol.* 29:637-646 (1995); Jefferson et al., *EMBO J.* 6:3901-3907 (1987); Wilmink et al., *Plant Mol. Biol.* 28:949-955 (1995)); (2) the *Arabidopsis* oleosin promoters (Plant et al., *Plant Mol. Biol.* 25:193-205 (1994); Li, Texas A&M University Ph.D. dissertation, pp. 107-128 (1997)); (3) the *Arabidopsis* ubiquitin extension protein promoters (Callis et al., *J. Biol. Chem.* 265(21):12486-93 (1990)); (4) a tomato ubiquitin gene promoter (Rollfinke et al., *Gene.* 211(2):267-76 (1998)); (5) a soybean heat shock protein promoter (Schoffl et al., *Mol Gen Genet.* 217(2-3): 246-53 (1989)); and, (6) a maize H3 histone gene promoter (Atanassova et al., *Plant Mol. Biol.* 37(2):275-85 (1989)).

Another useful feature of the annexin promoter is its expression profile in developing seeds. The annexin promoter is most active in developing seeds at early stages (before 10 days after pollination) and is largely quiescent in later stages. The expression profile of the annexin promoter is different from that of many seed-specific promoters, e.g., seed storage protein promoters, which often provide highest activity in later stages of development (Chen et al., *Dev. Genet.* 10:112-122 (1989); Ellerstrom et al., *Plant Mol. Biol.* 32:1019-1027 (1996); Keddie et al., *Plant Mol. Biol.* 24:327-340 (1994); Plant et al., (supra); L1, (supra)). The annexin promoter has a more conventional expression profile but remains distinct from other known seed specific promoters. Thus, the annexin promoter will be a very attractive candidate when overexpression, or suppression, of a gene in embryos is desired at an early developing stage. For example, it may be desirable to overexpress a gene regulating early embryo development or a gene involved in the metabolism prior to seed maturation.

Following identification of an appropriate promoter suitable for expression of a specific DHA synthase coding sequence, the promoter is then operably linked in a sense orientation using conventional means well known to those skilled in the art.

Standard recombinant DNA and molecular cloning techniques used herein are well known in the art and are described more fully in Sambrook, J. et al., In *Molecular Cloning: A Laboratory Manual*; 2$^{nd}$ ed.; Cold Spring Harbor Laboratory Press: Cold Spring Harbor, N.Y., 1989 (hereinafter "Sambrook et al., 1989") or Ausubel, F. M., Brent, R., Kingston, R. E., Moore, D. D., Seidman, J. G., Smith, J. A. and Struhl, K., Eds.; In *Current Protocols in Molecular Biology*; John Wiley and Sons: New York, 1990 (hereinafter "Ausubel et al., 1990"). For example, a fusion gene can be constructed by linking at least two DNA fragments in frame so as not to introduce a stop codon (in-frame fusion). The resulting fusion gene will be such that each DNA fragment encodes for at least one independent and separable enzymatic activity.

Once the recombinant construct has been made, it may then be introduced into a plant cell of choice by methods well known to those of ordinary skill in the art (e.g., transfection, transformation and electroporation). Oilseed plant cells are the preferred plant cells. The transformed plant cell is then cultured and regenerated under suitable conditions permitting expression of the long-chain PUFA which is then optionally recovered and purified.

The recombinant constructs of the invention may be introduced into one plant cell; or, alternatively, each construct may be introduced into separate plant cells.

Expression in a plant cell may be accomplished in a transient or stable fashion as is described above.

The desired long-chain PUFAs can be expressed in seed. Also within the scope of this invention are seeds or plant parts obtained from such transformed plants.

Plant parts include differentiated and undifferentiated tissues including, but not limited to the following: roots, stems, shoots, leaves, pollen, seeds, tumor tissue and various forms of cells and culture (e.g., single cells, protoplasts, embryos and callus tissue). The plant tissue may be in plant or in a plant organ, tissue or cell culture.

The term "plant organ" refers to plant tissue or a group of tissues that constitute a morphologically and functionally distinct part of a plant. The term "genome" refers to the following: (1) the entire complement of genetic material (genes and non-coding sequences) that is present in each cell of an organism, or virus or organelle; and/or (2) a complete set of chromosomes inherited as a (haploid) unit from one parent.

Thus, this invention also concerns a method for transforming a cell, comprising transforming a cell with the recombinant construct of the invention and selecting those cells transformed with the recombinant constructs described in the claims.

Also of interest is a method for producing a transformed plant comprising transforming a plant cell with the polynucleotides of the instant invention and regenerating a plant from the transformed plant cell.

Methods for transforming dicots (primarily by use of *Agrobacterium tumefaciens*) and obtaining transgenic plants have been published, among others, for: cotton (U.S. Pat. No. 5,004,863; U.S. Pat. No. 5,159,135); soybean (U.S. Pat. No. 5,569,834; U.S. Pat. No. 5,416,011); *Brassica* (U.S. Pat. No.

5,463,174); peanut (Cheng et al. *Plant Cell Rep.* 15:653-657 (1996); McKently et al. *Plant Cell Rep.* 14:699-703 (1995)); papaya (Ling, K. et al. *Bio/technology* 9:752-758 (1991)); and pea (Grant et al. *Plant Cell Rep.* 15:254-258 (1995)). For a review of other commonly used methods of plant transformation see Newell, C.A. (*Mol. Biotechnol.* 16:53-65 (2000)). One of these methods of transformation uses *Agrobacterium rhizogenes* (Tepfler, M. and Casse-Delbart, F. *Microbiol.* Sci. 4:24-28 (1987)). Transformation of soybeans using direct delivery of DNA has been published using PEG fusion (PCT Publication No. WO 92/17598), electroporation (Chowrira, G. M. et al., *Mol. Biotechnol.* 3:17-23 (1995); Christou, P. et al., *Proc. Natl. Acad. Sci. U.S.A.* 84:3962-3966 (1987)), microinjection and particle bombardement (McCabe, D. E. et. al., *Bio/Technology* 6:923 (1988); Christou et al., *Plant Physiol.* 87:671-674 (1988)).

There are a variety of methods for the regeneration of plants from plant tissue. The particular method of regeneration will depend on the starting plant tissue and the particular plant species to be regenerated. The regeneration, development and cultivation of plants from single plant protoplast transformants or from various transformed explants is well known in the art (Weissbach and Weissbach, In: Methods for Plant Molecular Biology, (Eds.), Academic: San Diego, Calif. (1988)). This regeneration and growth process typically includes the steps of selection of transformed cells and culturing those individualized cells through the usual stages of embryonic development through the rooted plantlet stage. Transgenic embryos and seeds are similarly regenerated. The resulting transgenic rooted shoots are thereafter planted in an appropriate plant growth medium such as soil. Preferably, the regenerated plants are self-pollinated to provide homozygous transgenic plants. Otherwise, pollen obtained from the regenerated plants is crossed to seed-grown plants of agronomically important lines. Conversely, pollen from plants of these important lines is used to pollinate regenerated plants. A transgenic plant of the present invention containing a desired polypeptide is cultivated using methods well known to one skilled in the art.

In addition to the above discussed procedures, practitioners are familiar with the standard resource materials which describe specific conditions and procedures for: the construction, manipulation and isolation of macromolecules (e.g., DNA molecules, plasmids, etc.); the generation of recombinant DNA fragments and recombinant expression constructs; and, the screening and isolating of clones. See, for example: Sambrook et al., Molecular Cloning: A Laboratory Manual, Cold Spring Harbor: NY (1989); Maliga et al., Methods in Plant Molecular Biology, Cold Spring Harbor: NY (1995); Birren et al., Genome Analysis: Detecting Genes, Vol. 1, Cold Spring Harbor: NY (1998); Birren et al., Genome Analysis: Analyzing DNA, Vol. 2, Cold Spring Harbor: NY (1998); Plant Molecular Biology: A Laboratory Manual, eds. Clark, Springer: NY (1997).

Examples of oilseed plants include, but are not limited to: soybean, *Brassica* species, sunflower, maize, cotton, flax and safflower.

Examples of PUFAs having at least twenty carbon atoms and four or more carbon-carbon double bonds include, but are not limited to, omega-3 fatty acids such as EPA, DPA, and DHA. Seeds obtained from such plants are also within the scope of this invention as well as oil obtained from such seeds.

Thus, the present invention also concerns a method for altering the fatty acid profile of an oilseed plant comprising:
a) transforming an oilseed plant cell with the recombinant construct of claim of the invention; and
b) regenerating a plant from the transformed oilseed plant cell step (a), wherein the plant has an altered fatty acid profile.

Microbial Expression Systems, Cassettes and Vectors

The DHA synthase genes and gene products described herein (i.e., EgDHAsyn1, EgDHAsyn2, EaDHAsyn1, EaDHAsyn2 and EaDHAsyn3, or other mutant enzymes, codon-optimized enzymes or homologs thereof) may also be produced in heterologous microbial host cells, particularly in the cells of oleaginous yeasts (e.g., *Yarrowia lipolytica*).

Microbial expression systems and expression vectors containing regulatory sequences that direct high level expression of foreign proteins are well known to those skilled in the art. Any of these could be used to construct chimeric genes for production of any of the gene products of the instant sequences. These chimeric genes could then be introduced into appropriate microorganisms via transformation to provide high-level expression of the encoded enzymes.

Vectors useful for the transformation of suitable microbial host cells are well known in the art. The specific choice of sequences present in the construct is dependent upon the desired expression products (supra), the nature of the host cell and the proposed means of separating transformed cells versus non-transformed cells. Typically, however, the vector contains at least one expression cassette, a selectable marker and sequences allowing autonomous replication or chromosomal integration. Suitable expression cassettes comprise a region 5' of the gene that controls transcriptional initiation (e.g., a promoter), the gene coding sequence, and a region 3' of the DNA fragment that controls transcriptional termination (i.e., a terminator). It is most preferred when both control regions are derived from genes from the transformed microbial host cell, although it is to be understood that such control regions need not be derived from the genes native to the specific species chosen as a production host.

Initiation control regions or promoters which are useful to drive expression of the instant multizymes, such as DHA synthase or individual domain ORFs, in the desired microbial host cell are numerous and familiar to those skilled in the art. Virtually any promoter capable of directing expression of these genes in the selected host cell is suitable for the present invention. Expression in a microbial host cell can be accomplished in a transient or stable fashion. Transient expression can be accomplished by inducing the activity of a regulatable promoter operably linked to the gene of interest. Stable expression can be achieved by the use of a constitutive promoter operably linked to the gene of interest. As an example, when the host cell is yeast, transcriptional and translational regions functional in yeast cells are provided, particularly from the host species (e.g., see U.S. Pat. No. 7,238,482 and PCT Publication No. WO 2006/052870 for preferred transcriptional initiation regulatory regions for use in *Yarrowia lipolytica*). Any one of a number of regulatory sequences can be used, depending upon whether constitutive or induced transcription is desired, the efficiency of the promoter in expressing the ORF of interest, the ease of construction and the like.

Nucleotide sequences surrounding the translational initiation codon 'ATG' have been found to affect expression in yeast cells. If the desired polypeptide is poorly expressed in yeast, the nucleotide sequences of exogenous genes can be modified to include an efficient yeast translation initiation sequence to obtain optimal gene expression. For expression in yeast, this can be done by site-directed mutagenesis of an inefficiently expressed gene by fusing it in-frame to an endogenous yeast gene, preferably a highly expressed gene. Alternatively, one can determine the consensus translation initiation sequence in the host and engineer this sequence into heterologous genes for their optimal expression in the host of interest.

The termination region can be derived from the 3' region of the gene from which the initiation region was obtained or from a different gene. A large number of termination regions are known and function satisfactorily in a variety of hosts (when utilized both in the same and different genera and species from where they were derived). The termination region usually is selected more as a matter of convenience rather than because of any particular property. Termination control regions may also be derived from various genes native to the preferred hosts. In alternate embodiments, the 3'-region can also be synthetic, as one of skill in the art can utilize available information to design and synthesize a 3'-region sequence that functions as a transcription terminator. Optionally, a termination site may be unnecessary; however, it is most preferred if included.

As one of skill in the art is aware, merely inserting a gene into a cloning vector does not ensure that it will be successfully expressed at the level needed. In response to the need for a high expression rate, many specialized expression vectors have been created by manipulating a number of different genetic elements that control aspects of transcription, translation, protein stability, oxygen limitation and secretion from the microbial host cell. More specifically, some of the molecular features that have been manipulated to control gene expression include: the nature of the relevant transcriptional promoter and terminator sequences; the number of copies of the cloned gene; whether the gene is plasmid-borne or integrated into the genome of the host cell; the final cellular location of the synthesized foreign protein; the efficiency of translation and correct folding of the protein in the host organism; the intrinsic stability of the mRNA and protein of the cloned gene within the host cell; and the codon usage within the cloned gene, such that its frequency approaches the frequency of preferred codon usage of the host cell. Each type of modification is encompassed in the present invention, as means to further optimize expression of the DHA synthases described herein.

Transformation of Microbial Host Cells

Once a cassette that is suitable for expression in an appropriate host cell has been obtained (e.g., a chimeric gene comprising a promoter, ORF and terminator), it is placed in a plasmid vector capable of autonomous replication in a host cell, or is directly integrated into the genome of the host cell. Integration of expression cassettes can occur randomly within the host genome or can be targeted through the use of constructs containing regions of homology with the host genome sufficient to target recombination within the host locus. Where constructs are targeted to an endogenous locus, all or some of the transcriptional and translational regulatory regions can be provided by the endogenous locus.

Where two or more genes are expressed from separate replicating vectors, it is desirable that each vector has a different means of selection and should lack homology to the other construct(s) to maintain stable expression and prevent reassortment of elements among constructs. Judicious choice of regulatory regions, selection means and method of propagation of the introduced construct(s) can be experimentally determined so that all introduced genes are expressed at the necessary levels to provide for synthesis of the desired products.

Constructs comprising the gene(s) of interest may be introduced into a microbial host cell by any standard technique. These techniques include transformation (e.g., lithium acetate transformation [*Methods in Enzymology*, 194:186-187 (1991)]), protoplast fusion, biolistic impact, electroporation, microinjection, or any other method that introduces the gene(s) of interest into the host cell.

For convenience, a host cell that has been manipulated by any method to take up a DNA sequence (e.g., an expression cassette) will be referred to as "transformed" or "recombinant" herein. The transformed host will have at least one copy of the expression construct and may have two or more, depending upon whether the expression cassette is integrated into the genome or is present on an extrachromosomal element having multiple copy numbers.

The transformed host cell can be identified by various selection techniques, as described in U.S. Pat. Nos. 7,238,482 and 7,259,255 and PCT Publication No. WO 2006/052870.

Following transformation, substrates suitable for the instant DHA synthases (and, optionally other PUFA enzymes that are co-expressed within the host cell) may be produced by the host either naturally or transgenically, or may be provided exogenously.

Preferred Microbial Hosts for Recombinant Expression

Microbial host cells for expression of the instant genes and nucleic acid fragments may include hosts that grow on a variety of feedstocks, including simple or complex carbohydrates, fatty acids, organic acids, oils and alcohols, and/or hydrocarbons over a wide range of temperature and pH values. Based on the needs of the Applicants' Assignee, the genes described in the instant invention will be expressed in an oleaginous yeast (and in particular *Yarrowia lipolytica*); however, it is contemplated that because transcription, translation and the protein biosynthetic apparatus are highly conserved, any bacteria, yeast, algae, euglenoid and/or fungus will be a suitable microbial host for expression of the present nucleic acid fragments.

Preferred microbial hosts, however, are oleaginous organisms, such as oleaginous yeasts. These organisms are naturally capable of oil synthesis and accumulation, wherein the oil can comprise greater than about 25% of the cellular dry weight, more preferably greater than about 30% of the cellular dry weight, and most preferably greater than about 40% of the cellular dry weight. Genera typically identified as oleaginous yeast include, but are not limited to: *Yarrowia, Candida, Rhodotorula, Rhodosporidium, Cryptococcus, Trichosporon* and *Lipomyces*. More specifically, illustrative oil-synthesizing yeasts include: *Rhodosporidium toruloides, Lipomyces starkeyii, L. lipoferus, Candida revkaufi, C. pulcherrima, C. tropicalis, C. utilis, Trichosporon pullans, T. cutaneum, Rhodotorula glutinus, R. graminis*, and *Yarrowia lipolytica* (formerly classified as *Candida lipolytica*).

Most preferred is the oleaginous yeast *Yarrowia lipolytica*; and, in a further embodiment, most preferred are the *Y. lipolytica* strains designated as ATCC #20362, ATCC #8862, ATCC #18944, ATCC #76982 and/or LGAM S(7)1 (Papanikolaou S., and Aggelis G., Bioresour. Technol. 82(1):43-9 (2002)).

Historically, various strains of *Y. lipolytica* have been used for the manufacture and production of: isocitrate lyase; lipases; polyhydroxyalkanoates; citric acid; erythritol; 2-oxoglutaric acid; gamma-decalactone; gamma-dodecalatone; and pyruvic acid. Specific teachings applicable for transformation of oleaginous yeasts (i.e., *Yarrowia lipolytica*) include U.S. Pat. No. 4,880,741 and U.S. Pat. No. 5,071,764 and Chen, D. C. et al. (*Appl. Microbiol. Biotechnol.*, 48(2): 232-235 (1997)). Specific teachings applicable for engineering ARA, EPA and DHA production in *Y. lipolytica* are provided in U.S. patent application Ser. No. 11/264,784 (PCT Publication No. WO 2006/055322), U.S. patent application Ser. No. 11/265,761 (PCT Publication No. WO 2006/

052870) and U.S. patent application Ser. No. 11/264,737 (PCT Publication No. WO 2006/052871), respectively.

Detailed means for the synthesis and transformation of expression vectors comprising C20 elongases and delta-4 desaturases in oleaginous yeast (i.e., *Yarrowia lipolytica*) are provided in PCT Publication No. WO 2006/052871. The preferred method of expressing genes in *Yarrowia lipolytica* is by integration of linear DNA into the genome of the host. Integration into multiple locations within the genome can be particularly useful when high level expression of genes are desired [e.g., in the Ura3 locus (GenBank Accession No. AJ306421), the Leu2 gene locus (GenBank Accession No. AF260230), the Lys5 gene locus (GenBank Accession No. M34929), the Aco2 gene locus (GenBank Accession No. AJ001300), the Pox3 gene locus (Pox3: GenBank Accession No. XP_503244; or, Aco3: GenBank Accession No. AJ001301), the delta-12 desaturase gene locus (U.S. Pat. No. 7,214,491), the Lip1 gene locus (GenBank Accession No. Z50020), the Lip2 gene locus (GenBank Accession No. AJ012632), and/or the Pex10 gene locus (GenBank Accession No. CAG81606)].

Termination regions useful in the disclosure herein for *Yarrowia* expression vectors include, for example: ~100 bp of the 3' region of the *Yarrowia lipolytica* extracellular protease (XPR; GenBank Accession No. M17741); the acyl-CoA oxidase (Aco3: GenBank Accession No. AJ001301 and No. CAA04661; Pox3: GenBank Accession No. XP_503244) terminators; the Pex20 (GenBank Accession No. AF054613) terminator; the Pex16 (GenBank Accession No. U75433) terminator; the Lip1 (GenBank Accession No. Z50020) terminator; the Lip2 (GenBank Accession No. AJ012632) terminator; and the 3-oxoacyl-CoA thiolase (OCT; GenBank Accession No. X69988) terminator.

Preferred selection methods for use in *Yarrowia lipolytica* are resistance to kanamycin, hygromycin, and the amino glycoside G418, as well as the ability to grow on media lacking uracil, leucine, lysine, tryptophan or histidine. In alternate embodiments, 5-fluoroorotic acid (5-fluorouracil-6-carboxylic acid monohydrate; "5-FOA") is used for selection of yeast Ura⁻ mutants. The compound is toxic to yeast cells that possess a functioning URA3 gene encoding orotidine 5'-monophosphate decarboxylase (OMP decarboxylase); thus, based on this toxicity, 5-FOA is especially useful for the selection and identification of Ura⁻ mutant yeast strains (Bartel, P. L. and Fields, S., Yeast 2-Hybrid System, Oxford University: New York, v. 7, pp 109-147,1997; see also PCT Publication No. WO 2006/052870 for 5-FOA use in *Yarrowia*). More specifically, one can first knockout the native Ura3 gene to produce a strain having a Ura- phenotype, wherein selection occurs based on 5-FOA resistance. Then, a cluster of multiple chimeric genes and a new Ura3 gene can be integrated into a different locus of the *Yarrowia* genome to produce a new strain having a Ura+ phenotype. Subsequent integration produces a new Ura3-strain (again identified using 5-FOA selection), when the introduced Ura3 gene is knocked out. Thus, the Ura3 gene (in combination with 5-FOA selection) can be used as a selection marker in multiple rounds of transformation, thereby readily permitting genetic modifications to be integrated into the *Yarrowia* genome in a facile manner.

Other preferred microbial hosts include oleaginous bacteria, algae, euglenoids, and other fungi; and, within this broad group of microbial hosts, of particular interest are microorganisms that synthesize omega-3/omega-6 fatty acids (or those that can be genetically engineered for this purpose [e.g., other yeast such as *Saccharomyces cerevisiae*]). Thus, for example, transformation of *Mortierella alpina* (which is commercially used for production of ARA) with any of the instant DHA synthase genes under the control of inducible or regulated promoters could yield a transformant organism capable of synthesizing increased quantities of PUFAs. The method of transformation of *M. alpina* is described by Mackenzie et al. (*Appl. Environ. Microbiol.*, 66:4655 (2000)). Similarly, methods for transformation of Thraustochytriales microorganisms are disclosed in U.S. Pat. No. 7,001,772.

Substrate feeding may be required.

Irrespective of the host selected for expression of the multizymes (e.g. DHA synthases), multiple transformants must be screened in order to obtain a strain displaying the desired expression level and pattern. Such screening may be accomplished by Southern analysis of DNA blots (Southern, *J. Mol. Biol.*, 98:503 (1975)), Northern analysis of mRNA expression (Kroczek, *J. Chromatogr. Biomed. Appl.*, 618(1-2):133-145 (1993)), Western and/or Elisa analyses of protein expression, phenotypic analysis, or GC analysis of the PUFA products.

Of course, since naturally produced PUFAs in oleaginous yeast are limited to 18:2 fatty acids (i.e., LA), and less commonly, 18:3 fatty acids (i.e., ALA), in more preferred embodiments of the present invention, the oleaginous yeast will be genetically engineered to express multiple enzymes necessary for long-chain PUFA biosynthesis (thereby enabling production of e.g., ARA, EPA, DPA and DHA), in addition to the multizymes described herein.

In particularly preferred embodiments, the at least one additional recombinant DNA construct encode a DGLA synthase, such that the multizyme has both delta-9 elongase activity and delta-8 desaturase activity. In some embodiments the delta-9 elongase can be isolated or derived from *Isochrysis galbana* (GenBank Accession No. AF390174; IgD9e or IgD9eS) or the delta-9 elongase can be isolated or derived from *Euglena gracilis* or *Euglena anabaena*. For example, see the DGLA synthases set forth as SEQ ID NO:441, SEQ ID NO:447, SEQ ID NO:454, SEQ ID NO:461, SEQ ID NO:464 and SEQ ID NO:471.

Metabolic Engineering of Omega-3 and/or Omega-6 Fatty Acid Biosynthesis in Microbes Methods for manipulating biochemical pathways are well known to those skilled in the art; and, it is expected that numerous manipulations will be possible to maximize omega-3 and/or omega-6 fatty acid biosynthesis in oleaginous yeasts, and particularly, in *Yarrowia lipolytica*. This manipulation may require metabolic engineering directly within the PUFA biosynthetic pathway or additional manipulation of pathways that contribute carbon to the PUFA biosynthetic pathway. Methods useful for up-regulating desirable biochemical pathways and down-regulating undesirable biochemical pathways are well known to those skilled in the art.

For example, biochemical pathways competing with the omega-3 and/or omega-6 fatty acid biosynthetic pathways for energy or carbon, or native PUFA biosynthetic pathway enzymes that interfere with production of a particular PUFA end-product, may be eliminated by gene disruption or down-regulated by other means (e.g., antisense mRNA).

Detailed discussion of manipulations within the PUFA biosynthetic pathway as a means to increase ARA, EPA or DHA (and associated techniques thereof) are presented in PCT Publication Nos. WO 2006/055322 [U.S. Patent Publication No. 2006-0094092-A1], PCT Publication No. WO 2006/052870 [U.S. Patent Publication No. 2006-0115881-A1] and PCT Publication No. WO 2006/052871 [U.S. Patent Publication No. 2006-0110806-A1], respectively, as are desirable manipulations in the TAG biosynthetic pathway and the TAG degradation pathway (and associated techniques thereof).

Within the context of the present invention, it may be useful to modulate the expression of the fatty acid biosynthetic pathway by any one of the strategies described above. For example, the present invention provides methods whereby genes encoding key enzymes in the PUFA biosynthetic pathway are introduced into oleaginous yeasts for the production of omega-3 and/or omega-6 fatty acids. It will be particularly useful to express the instant DHA synthase genes in oleaginous yeasts that do not naturally possess omega-3 and/or omega-6 fatty acid biosynthetic pathways and coordinate the expression of these genes, to maximize production of preferred PUFA products using various means for metabolic engineering of the host organism.

Microbial Fermentation Processes for PUFA Production

The transformed host cell is grown under conditions that optimize expression of chimeric genes and produce the greatest and most economical yield of desired PUFAs. In general, media conditions that may be optimized include the type and amount of carbon source, the type and amount of nitrogen source, the carbon-to-nitrogen ratio, the amount of different mineral ions, the oxygen level, growth temperature, pH, length of the biomass production phase, length of the oil accumulation phase and the time and method of cell harvest. *Yarrowia lipolytica* are generally grown in complex media (e.g., yeast extract-peptone-dextrose broth (YPD)) or a defined minimal media that lacks a component necessary for growth and thereby forces selection of the desired expression cassettes (e.g., Yeast Nitrogen Base (DIFCO Laboratories, Detroit, Mich.)).

Fermentation media in the present invention must contain a suitable carbon source. Suitable carbon sources are taught in U.S. Pat. No. 7,238,482. Although it is contemplated that the source of carbon utilized in the present invention may encompass a wide variety of carbon-containing sources, preferred carbon sources are sugars, glycerol, and/or fatty acids. Most preferred is glucose and/or fatty acids containing between 10-22 carbons.

Nitrogen may be supplied from an inorganic (e.g., $(NH_4)_2SO_4$) or organic (e.g., urea or glutamate) source. In addition to appropriate carbon and nitrogen sources, the fermentation media must also contain suitable minerals, salts, cofactors, buffers, vitamins and other components known to those skilled in the art suitable for the growth of the oleaginous host and promotion of the enzymatic pathways necessary for PUFA production. Particular attention is given to several metal ions (e.g., $Fe^{+2}$, $Cu^{+2}$, $Mn^{+2}$, $Co^{+2}$, $Zn^{+2}$, $Mg^{+2}$) that promote synthesis of lipids and PUFAs (Nakahara, T. et al., *Ind. Appl. Single Cell Oils*, D. J. Kyle and R. Colin, eds. pp 61-97 (1992)).

Preferred growth media in the present invention are common commercially prepared media, such as Yeast Nitrogen Base (DIFCO Laboratories, Detroit, Mich.). Other defined or synthetic growth media may also be used and the appropriate medium for growth of the transformant host cells will be known by one skilled in the art of microbiology or fermentation science. A suitable pH range for the fermentation is typically between about pH 4.0 to pH 8.0, wherein pH 5.5 to pH 7.5 is preferred as the range for the initial growth conditions. The fermentation may be conducted under aerobic or anaerobic conditions, wherein microaerobic conditions are preferred.

Typically, accumulation of high levels of PUFAs in oleaginous yeast cells requires a two-stage process, since the metabolic state must be "balanced" between growth and synthesis/storage of fats. Thus, most preferably, a two-stage fermentation process is necessary for the production of PUFAs in oleaginous yeast (e.g., *Yarrowia lipolytica*). This approach is described in U.S. Pat. No. 7,238,482, as are various suitable fermentation process designs (i.e., batch, fed-batch and continuous) and considerations during growth.

Purification and Processing of PUFA Oils

PUFAs may be found in the host microorganisms and plants as free fatty acids or in esterified forms such as acylglycerols, phospholipids, sulfolipids, or glycolipids, and may be extracted from the host cells through a variety of means well-known in the art. One review of extraction techniques, quality analysis, and acceptability standards for yeast lipids is that of Z. Jacobs (*Critical Reviews in Biotechnology*, 12(5/6): 463-491 (1992)). A brief review of downstream processing is also available by A. Singh and O. Ward (*Adv. Appl. Microbiol.*, 45:271-312 (1997)).

In general, means for the purification of PUFAs may include extraction (e.g., U.S. Pat. No. 6,797,303 and U.S. Pat. No. 5,648,564) with organic solvents, sonication, supercritical fluid extraction (e.g., using carbon dioxide), saponification and physical means such as presses, or combinations thereof. One is referred to the teachings of U.S. Pat. No. 7,238,482 for additional details. Methods of isolating seed oils are well known in the art: (Young et al., Processing of Fats and Oils, In *The Lipid Handbook*, Gunstone et al., eds., Chapter 5 pp 253-257; Chapman & Hall: London (1994)). For example, soybean oil is produced using a series of steps involving the extraction and purification of an edible oil product from the oil-bearing seed. Soybean oils and soybean byproducts are produced using the generalized steps shown in Table 7.

TABLE 7

Generalized Steps for Soybean Oil and Byproduct Production

| Process Step | Process | Impurities Removed and/or By-Products Obtained |
|---|---|---|
| # 1 | soybean seed | |
| # 2 | oil extraction | meal |
| # 3 | Degumming | lecithin |
| # 4 | alkali or physical refining | gums, free fatty acids, pigments |
| # 5 | water washing | soap |
| # 6 | Bleaching | color, soap, metal |
| # 7 | (hydrogenation) | |
| # 8 | (winterization) | stearine |
| # 9 | Deodorization | free fatty acids, tocopherols, sterols, volatiles |
| # 10 | oil products | |

More specifically, soybean seeds are cleaned, tempered, dehulled, and flaked, thereby increasing the efficiency of oil extraction. Oil extraction is usually accomplished by solvent (e.g., hexane) extraction but can also be achieved by a combination of physical pressure and/or solvent extraction. The resulting oil is called crude oil. The crude oil may be degummed by hydrating phospholipids and other polar and neutral lipid complexes that facilitate their separation from the nonhydrating, triglyceride fraction (soybean oil). The resulting lecithin gums may be further processed to make commercially important lecithin products used in a variety of food and industrial products as emulsification and release (i.e., antisticking) agents. Degummed oil may be further refined for the removal of impurities (primarily free fatty acids, pigments and residual gums). Refining is accomplished by the addition of a caustic agent that reacts with free fatty acid to form soap and hydrates phosphatides and proteins in the crude oil. Water is used to wash out traces of soap formed during refining. The soapstock byproduct may be used directly in animal feeds or acidulated to recover the free fatty acids. Color is removed through adsorption with a bleaching earth that removes most of the chlorophyll and carotenoid compounds. The refined oil can be hydrogenated, thereby resulting in fats with various melting properties and textures. Winterization (fractionation) may be used to remove stearine from the hydrogenated oil through crystallization under carefully controlled cooling conditions. Deodorization (principally via steam distillation under vacuum) is the last step and is designed to remove compounds which impart odor or flavor to the oil. Other valuable byproducts such as tocopherols and sterols may be removed during the deodorization process. Deodorized distillate containing these byproducts may be sold for production of natural vitamin E and other high-value pharmaceutical products. Refined, bleached, (hydrogenated, fractionated) and deodorized oils and fats may be packaged and sold directly or further processed into more specialized products. A more detailed reference to soybean seed processing, soybean oil production, and byproduct utilization can be found in Erickson, Practical Handbook of Soybean Processing and Utilization, The American Oil Chemists' Society and United Soybean Board (1995). Soybean oil is liquid at room temperature because it is relatively low in saturated fatty acids when compared with oils such as coconut, palm, palm kernel, and cocoa butter.

Plant and microbial oils containing PUFAs that have been refined and/or purified can be hydrogenated, thereby resulting in fats with various melting properties and textures. Many processed fats (including spreads, confectionary fats, hard butters, margarines, baking shortenings, etc.) require varying degrees of solidity at room temperature and can only be produced through alteration of the source oil's physical properties. This is most commonly achieved through catalytic hydrogenation.

Hydrogenation is a chemical reaction in which hydrogen is added to the unsaturated fatty acid double bonds with the aid of a catalyst such as nickel. For example, high oleic soybean oil contains unsaturated oleic, linoleic, and linolenic fatty acids, and each of these can be hydrogenated. Hydrogenation has two primary effects. First, the oxidative stability of the oil is increased as a result of the reduction of the unsaturated fatty acid content. Second, the physical properties of the oil are changed because the fatty acid modifications increase the melting point resulting in a semi-liquid or solid fat at room temperature.

There are many variables which affect the hydrogenation reaction, which in turn alter the composition of the final product. Operating conditions including pressure, temperature, catalyst type and concentration, agitation, and reactor design are among the more important parameters that can be controlled. Selective hydrogenation conditions can be used to hydrogenate the more unsaturated fatty acids in preference to the less unsaturated ones. Very light or brush hydrogenation is often employed to increase stability of liquid oils. Further hydrogenation converts a liquid oil to a physically solid fat. The degree of hydrogenation depends on the desired performance and melting characteristics designed for the particular end product. Liquid shortenings (used in the manufacture of baking products, solid fats and shortenings used for commercial frying and roasting operations) and base stocks for margarine manufacture are among the myriad of possible oil and fat products achieved through hydrogenation. A more detailed description of hydrogenation and hydrogenated products can be found in Patterson, H. B. W., Hydrogenation of Fats and Oils: Theory and Practice. The American Oil Chemists' Society (1994).

Hydrogenated oils have become somewhat controversial due to the presence of trans-fatty acid isomers that result from the hydrogenation process. Ingestion of large amounts of trans-isomers has been linked with detrimental health effects including increased ratios of low density to high density lipoproteins in the blood plasma and increased risk of coronary heart disease.

PUFA-Containing Oils for Use in Foodstuffs, Health Food Products, Pharmaceuticals and Animal Feeds The market place currently supports a large variety of food and feed products, incorporating omega-3 and/or omega-6 fatty acids (particularly e.g., ALA, GLA, ARA, EPA, DPA and DHA). It is contemplated that the PUFA-comprising plant/seed oils, altered seeds, and microbial biomass and/or oils of the invention will function in food and feed products to impart the health benefits of current formulations. Compared to other vegetable oils, the oils of the invention are believed to function similarly to other oils in food applications from a physical standpoint (for example, partially hydrogenated oils such as soybean oil are widely used as ingredients for soft spreads, margarine and shortenings for baking and frying).

Plant/seed oils, altered seeds, and microbial biomass and/or oils containing omega-3 and/or omega-6 fatty acids will be suitable for use in a variety of food and feed products including, but not limited to: food analogs, meat products, cereal products, baked foods, snack foods and dairy products.

Additionally, the present plant/seed oils, altered seeds, and microbial biomass and/or oils may be used in formulations to impart health benefit in medical foods including medical nutritionals, dietary supplements, infant formula as well as pharmaceutical products. One of skill in the art of food processing and food formulation will understand how the amount and composition of the plant and microbial oils may be added to the food or feed product. Such an amount will be referred to herein as an "effective" amount and will depend on the food or feed product, the diet that the product is intended to supplement or the medical condition that the medical food or medical nutritional is intended to correct or treat.

Food analogs can be made using processes well known to those skilled in the art. There can be mentioned meat analogs, cheese analogs, milk analogs and the like. Meat analogs made from soybeans contain soy protein or tofu and other ingredients mixed together to simulate various kinds of meats. These meat alternatives are sold as frozen, canned or dried foods. Usually, they can be used the same way as the foods they replace. Meat alternatives made from soybeans are excellent sources of protein, iron and B vitamins. Examples of meat analogs include, but are not limited to: ham analogs, sausage analogs, bacon analogs, and the like.

Food analogs can be classified as imitation or substitutes depending on their functional and compositional characteristics. For example, an imitation cheese need only resemble the cheese it is designed to replace. However, a product can generally be called a substitute cheese only if it is nutritionally equivalent to the cheese it is replacing and meets the minimum compositional requirements for that cheese. Thus, substitute cheese will often have higher protein levels than imitation cheeses and be fortified with vitamins and minerals.

Milk analogs or nondairy food products include, but are not limited to, imitation milks and nondairy frozen desserts (e.g., those made from soybeans and/or soy protein products).

Meat products encompass a broad variety of products. In the United States "meat" includes "red meats" produced from cattle, hogs and sheep. In addition to the red meats there are poultry items which include chickens, turkeys, geese, guineas, ducks and the fish and shellfish. There is a wide assortment of seasoned and processed meat products: fresh, cured and fried, and cured and cooked. Sausages and hot dogs are examples of processed meat products. Thus, the term "meat products" as used herein includes, but is not limited to, processed meat products.

A cereal food product is a food product derived from the processing of a cereal grain. A cereal grain includes any plant from the grass family that yields an edible grain (seed). The most popular grains are barley, corn, millet, oats, quinoa, rice, rye, sorghum, triticale, wheat and wild rice. Examples of a cereal food product include, but are not limited to: whole grain, crushed grain, grits, flour, bran, germ, breakfast cereals, extruded foods, pastas, and the like.

A baked goods product comprises any of the cereal food products mentioned above and has been baked or processed in a manner comparable to baking (i.e., to dry or harden by subjecting to heat). Examples of a baked good product include, but are not limited to: bread, cakes, doughnuts, bars, pastas, bread crumbs, baked snacks, mini-biscuits, mini-crackers, mini-cookies, and mini-pretzels. As was mentioned above, oils of the invention can be used as an ingredient.

A snack food product comprises any of the above or below described food products.

A fried food product comprises any of the above or below described food products that has been fried.

A health food product is any food product that imparts a health benefit. Many oilseed-derived food products may be considered as health foods.

A beverage can be in a liquid or in a dry powdered form.

For example, there can be mentioned non-carbonated drinks such as fruit juices, fresh, frozen, canned or concentrate; flavored or plain milk drinks, etc. Adult and infant nutritional formulas are well known in the art and commercially available (e.g., Similac®, Ensure®, Jevity®, and Alimentum® from Ross Products Division, Abbott Laboratories).

Infant formulas are liquids or reconstituted powders fed to infants and young children. "Infant formula" is defined herein as an enteral nutritional product which can be substituted for human breast milk in feeding infants and typically is composed of a desired percentage of fat mixed with desired percentages of carbohydrates and proteins in an aqueous solution (e.g., see U.S. Pat. No. 4,670,285). Based on the worldwide composition studies, as well as levels specified by expert groups, average human breast milk typically contains about 0.20% to 0.40% of total fatty acids (assuming about 50% of calories from fat); and, generally the ratio of DHA to ARA would range from about 1:1 to 1:2 (see, e.g., formulations of Enfamil LIPIL™ (Mead Johnson & Company) and Similac Advance™ (Ross Products Division, Abbott Laboratories)). Infant formulas have a special role to play in the diets of infants because they are often the only source of nutrients for infants; and, although breast-feeding is still the best nourishment for infants, infant formula is a close enough second that babies not only survive but thrive.

A dairy product is a product derived from milk. A milk analog or nondairy product is derived from a source other than milk, for example, soymilk as was discussed above. These products include, but are not limited to: whole milk, skim milk, fermented milk products such as yogurt or sour milk, cream, butter, condensed milk, dehydrated milk, coffee whitener, coffee creamer, ice cream, cheese, etc.

Additional food products into which the PUFA-containing oils of the invention could be included are, for example, chewing gums, confections and frostings, gelatins and puddings, hard and soft candies, jams and jellies, white granulated sugar, sugar substitutes, sweet sauces, toppings and syrups, and dry-blended powder mixes.

A health food product is any food product that imparts a health benefit and includes functional foods, medical foods, medical nutritionals and dietary supplements. Additionally, the plant/seed oils, altered seeds and microbial oils of the invention may be used in standard pharmaceutical compositions (e.g., the long-chain PUFA containing oils could readily be incorporated into the any of the above mentioned food products, to thereby produce a functional or medical food). More concentrated formulations comprising PUFAs include capsules, powders, tablets, softgels, gelcaps, liquid concentrates and emulsions which can be used as a dietary supplement in humans or animals other than humans.

Animal feeds are generically defined herein as products intended for use as feed or for mixing in feed for animals other than humans. The plant/seed oils, altered seeds and microbial oils of the invention can be used as an ingredient in various animal feeds.

More specifically, although not limited therein, it is expected that the oils of the invention can be used within pet food products, ruminant and poultry food products and aquacultural food products. Pet food products are those products intended to be fed to a pet (e.g., dog, cat, bird, reptile, and rodent). These products can include the cereal and health food products above, as well as meat and meat byproducts, soy protein products, grass and hay products (e.g., alfalfa, timothy, oat or brome grass, vegetables). Ruminant and poultry food products are those wherein the product is intended to be fed to an animal (e.g., turkeys, chickens, cattle, and swine). As with the pet foods above, these products can include cereal and health food products, soy protein products, meat and meat byproducts, and grass and hay products as listed above. Aquacultural food products (or "aquafeeds") are those products intended to be used in aquafarming, i.e., which concerns the propagation, cultivation, or farming of aquatic organisms and/or animals in fresh or marine waters.

EXAMPLES

The present invention is further defined in the following Examples, in which parts and percentages are by weight and degrees are Celsius, unless otherwise stated. It should be understood that these Examples, while indicating preferred embodiments of the invention, are given by way of illustration only. From the above discussion and these Examples, one skilled in the art can ascertain the essential characteristics of this invention, and without departing from the spirit and scope thereof, can make various changes and modifications of the invention to adapt it to various usages and conditions. Thus, various modifications of the invention in addition to those shown and described herein will be apparent to those skilled in the art from the foregoing description. Such modifications are also intended to fall within the scope of the appended claims.

The meaning of abbreviations is as follows: "sec" means second(s), "min" means minute(s), "h" means hour(s), "d" means day(s), "µL" means microliter(s), "mL" means milliliter(s), "L" means liter(s), "µM" means micromolar, "mM" means millimolar, "M" means molar, "mmol" means millimole(s), "µmole" mean micromole(s), "g" means gram(s), "µg" means microgram(s), "ng" means nanogram(s), "U" means unit(s), "bp" means base pair(s) and "kB" means kilobase(s).

General Methods:

Nomenclature for Expression Cassettes:

The structure of an expression cassette will be represented by a simple notation system of "X::Y::Z", wherein X describes the promoter fragment, Y describes the gene coding region fragment, and Z describes the terminator fragment, which are all operably linked to one another.

Transformation and Cultivation of *Yarrowia lipolytica*:

*Yarrowia lipolytica* strains with ATCC Accession Nos. #20362, #76982 and #90812 were purchased from the American Type Culture Collection (Rockville, Md.). *Yarrowia lipolytica* strains were typically grown at 28-30° C. in several media, according to the recipes shown below. Agar plates were prepared as required by addition of 20 g/L agar to each liquid media, according to standard methodology.

YPD agar medium (per liter): 10 g of yeast extract [Difco], 20 g of Bacto peptone [Difco]; and 20 g of glucose.

Basic Minimal Media (MM) (per liter): 20 g glucose; 1.7 g yeast nitrogen base without amino acids; 1.0 g proline; and pH 6.1 (not adjusted).

Minimal Media+Uracil (MM+uracil or MMU) (per liter): Prepare MM media as above and add 0.1 g uracil and 0.1 g uridine.

Minimal Media+Uracil+Sulfonylurea (MMU+SU) (per liter): Prepare MMU media as above and add 280 mg sulfonylurea.

Minimal Media+Leucine (MM+leucine or MMLeu) (per liter): Prepare MM media as above and add 0.1 g leucine.

Minimal Media+Leucine+Uracil (MMLeuUra) (per liter): Prepare MM media as above and add 0.1 g leucine, 0.1 g uracil and 0.1 g uridine.

Minimal Media+Leucine+Lysine (MMLeuLys) (per liter): Prepare MM media as above and add 0.1 g lysine, 0.1 g leucine.

Minimal Media+5-Fluoroorotic Acid (MM+5-FOA) (per liter): 20 g glucose, 6.7 g Yeast Nitrogen base, 75 mg uracil, 75 mg uridine and appropriate amount of FOA (Zymo Research Corp., Orange, Calif.), based on FOA activity testing against a range of concentrations from 100 mg/L to 1000 mg/L (since variation occurs within each batch received from the supplier).

High Glucose Media (HGM) (per liter): 80 glucose, 2.58 g $KH_2PO_4$ and 5.36 g $K_2HPO_4$, pH 7.5 (do not need to adjust).

Transformation of *Yarrowia lipolytica* was performed according to the method of Chen, D. C. et al. (*Appl. Microbiol. Biotechnol.* 48(2):232-235 (1997)), unless otherwise noted. Briefly, *Yarrowia* was streaked onto a YPD plate and grown at 30° C. for approximately 18 h. Several large loopfuls of cells were scraped from the plate and resuspended in 1 mL of transformation buffer, comprising: 2.25 mL of 50% PEG, average MW 3350; 0.125 mL of 2 M lithium acetate, pH 6.0; 0.125 mL of 2 M DTT; and (optionally) 50 µg sheared salmon sperm DNA. Then, approximately 500 ng of linearized plasmid DNA were incubated in 100 µL of resuspended cells and maintained at 39° C. for 1 hr with vortex mixing at 15 min intervals. The cells were plated onto selection media plates, which were maintained at 30° C. for 2 to 3 days.

Fatty Acid Analysis of *Yarrowia lipolytica*:

For fatty acid analysis, cells were collected by centrifugation and lipids were extracted as described in Bligh, E. G. & Dyer, W. J. (*Can. J. Biochem. Physiol.* 37:911-917 (1959)). Fatty acid methyl esters were prepared by transesterification of the lipid extract with sodium methoxide (Roughan, G. and Nishida I., *Arch Biochem Biophys.* 276(1):38-46 (1990)) and subsequently analyzed with a Hewlett-Packard 6890 GC fitted with a 30 m×0.25 mm (i.d.) HP-INNOWAX (Hewlett-Packard) column. The oven temperature was from 170° C. (25 min hold) to 185° C. at 3.5° C./min.

For direct base transesterification, *Yarrowia* culture (3 mL) was harvested, washed once in distilled water, and dried under vacuum in a Speed-Vac for 5-10 min. Sodium methoxide (100 µL of 1%) was added to the sample, which was then vortexed and rocked for 20 min. After adding 3 drops of 1 M NaCl and 400 µL hexane, the sample was vortexed and spun. The upper layer was removed and analyzed by GC as described above.

Construction Of *Yarrowia lipolytica* Strain Y4305U3:

*Y. lipolytica* strain Y4305U3 was used as the host in Examples 52, 53 and 54, infra. The following description is a summary of the construction of strain Y4305U3, derived from *Yarrowia lipolytica* ATCC #20362. Strain Y4305U3 is capable of producing about 53.2% EPA relative to the total lipids via expression of a delta-9 elongase/delta-8 desaturase pathway (FIG. 44).

The development of strain Y4305U3 required the construction of strain Y2224 (a FOA resistant mutant from an autonomous mutation of the Ura3 gene of wildtype *Yarrowia* strain ATCC #20362), strain Y4001 (producing 17% EDA with a Leu- phenotype), strain Y4001U1 (producing 17% EDA with a Leu- and Ura- phenotype), strain Y4036 (producing 18% DGLA with a Leu- phenotype), strain Y4036U (producing 18% DGLA with a Leu- and Ura- phenotype), strain Y4070 (producing 12% ARA with a Ura- phenotype), strain Y4086 (producing 14% EPA), strain Y4086U1 (Ura3-), strain Y4128 (producing 37% EPA), strain Y4128U3 (Ura-), strain Y4217 (producing 42% EPA), strain Y4217U2 (Ura-), strain Y4259 (producing 46.5% EPA) and strain Y4259U2 (Ura-).

Generation Of Strain Y2224:

Strain Y2224 was isolated in the following manner: *Yarrowia lipolytica* ATCC #20362 cells from a YPD agar plate were streaked onto a MM plate (75 mg/L each of uracil and uridine, 6.7 g/L YNB with ammonia sulfate, without amino acids, and 20 g/L glucose) containing 250 mg/L 5-FOA (Zymo Research). Plates were incubated at 28° C., and four of the resulting colonies were patched separately onto MM plates containing 200 mg/mL 5-FOA and MM plates lacking uracil and uridine. This was done to confirm uracil Ura3 auxotrophy.

Generation Of Strain Y4001 To Produce About 17% EDA Of Total Lipids:

Strain Y4001 was created via integration of construct pZKLeuN-29E3 (FIG. 45A). This construct, comprising four chimeric genes (i.e., a delta-12 desaturase, a $C_{16/18}$ elongase, and two delta-9 elongases), was integrated into the Leu2 loci of strain Y2224 to thereby enable production of EDA.

Construct pZKLeuN-29E3 contained the components shown below in Table 8.

TABLE 8

Description of Plasmid pZKLeuN-29E3 (SEQ ID NO: 315)

| RE Sites And Nucleotides Within SEQ ID NO: 315 | Description Of Fragment And Chimeric Gene Components |
|---|---|
| BsiW I/Asc I (7797-7002) | 788 bp 3' portion of *Yarrowia* Leu2 gene (GenBank Accession No. AF260230) |
| Sph I/Pac I (4302-3591) | 703 bp 5' portion of *Yarrowia* Leu2 gene (GenBank Accession No. AF260230) |
| Swa I/BsiW I | GPD::FmD12::Pex20, comprising: |

TABLE 8-continued

Description of Plasmid pZKLeuN-29E3 (SEQ ID NO: 315)

| RE Sites And Nucleotides Within SEQ ID NO: 315 | Description Of Fragment And Chimeric Gene Components |
|---|---|
| (10533-7797) | GPD: *Yarrowia lipolytica* GPD promoter (; U.S. Pat. No. 7,259,255); <br> FmD12: *Fusarium moniliforme* delta-12 desaturase gene (SEQ ID NO: 316) (labeled as "F.D12" in Figure; PCT Publication No. WO 2005/047485); <br> Pex20: Pex20 terminator sequence from *Yarrowia* Pex20 gene (GenBank Accession No. AF054613) |
| Bgl II/Swa I (12559-10533) | EXP1::EgD9eS::Lip1, comprising: <br> EXP1: *Yarrowia lipolytica* export protein (EXP1) promoter (labeled as "Exp pro" in Figure; U.S. Patent Application No. 11/265761); <br> EgD9eS: codon-optimized delta-9 elongase (SEQ ID NO: 318), derived from *Euglena gracilis* (labeled as "EgD9E" in Figure; PCT Publication No. WO 2007/061742); <br> Lip1: Lip1 terminator sequence from *Yarrowia* Lip1 gene (GenBank Accession No. Z50020) |
| Pme I/Cla I (12577-1) | FBAINm::EgD9eS::Lip2, comprising: <br> FBAINm: *Yarrowia lipolytica* FBAINm promoter (U.S. Pat. No. 7,202,356); <br> EgD9eS: codon-optimized delta-9 elongase gene (SEQ ID NO: 318), derived from *Euglena gracilis* (labeled as "EgD9ES" in Figure; PCT Publication No. WO 2007/061742); <br> Lip2: Lip2 terminator sequence from *Yarrowia* Lip2 gene (GenBank Accession No. AJ012632) |
| Cla I/EcoR I (1-1736) | LoxP::Ura3::LoxP, comprising: <br> LoxP sequence (SEQ ID NO: 320); <br> *Yarrowia* Ura3 gene (GenBank Accession No. AJ306421); <br> LoxP sequence (SEQ ID NO: 320) |
| EcoR I/Pac I (1736-3591) | YAT1::ME3S::Pex16, comprising: <br> YAT1: *Yarrowia lipolytica* YAT1 promoter (labeled as "YAT" in Figure; Patent Publication No. U.S. 2006/0094102-A1); <br> ME3S: codon-optimized $C_{16/18}$ elongase gene (SEQ ID NO: 321), derived from *M. alpina* (PCT Publication No. WO 2007/046817); <br> Pex16: Pex16 terminator sequence of *Yarrowia* Pex 16 gene (GenBank Accession No. U75433) |

Plasmid pZKLeuN-29E3 was digested with AscI/SphI and then used for transformation of *Y. lipolytica* strain Y2224 (i.e., ATCC #20362 Ura3-) according to the General Methods. The transformed cells were plated onto MMLeu media plates, and plates were maintained at 30° C. for 2 to 3 days. The colonies were picked and streaked onto MM and MMLeu selection plates. The colonies that could grow on MMLeu plates but not on MM plates were selected as Leu- strains. Single colonies of Leu- strains were used to inoculate liquid MMLeu, and the liquid cultures were shaken at 250 rpm/min for 2 days at 30° C. The cells were collected by centrifugation, and lipids were extracted. Fatty acid methyl esters were prepared by trans-esterification and subsequently analyzed with a Hewlett-Packard 6890 GC.

GC analyses showed the presence of EDA in the transformants containing the 4 chimeric genes of pZKLeuN-29E3, but not in the *Yarrowia* Y2224 control strain. Most of the selected 36 Leu- strains produced about 12 to 16.9% EDA of total lipids. Three strains, designated as strains Y4001, Y4002, and Y4003, produced about 17.4%, 17%, and 17.5% EDA of total lipids, respectively.

Single colonies of Y4001, Y4002, and Y4003 strains were used to inoculate liquid MMLeu, and the liquid cultures were shaken at 250 rpm/min for 2 days at 30° C. The cells were collected by centrifugation, resuspended in HGM, and then shaken at 250 rpm/min for 5 days. The cells were collected by centrifugation, and lipids were extracted. Fatty acid methyl esters were prepared by trans-esterification and subsequently analyzed with a Hewlett-Packard 6890 GC. GC analyses showed that the Y4001, Y4002, and Y4003 strains produced about 24% EDA of total lipids.

Generation Of Strain Y4001U (Leu-, Ura-):

Strain Y4001U was created via temporary expression of the Cre recombinase enzyme in plasmid pY116 (FIG. 45B) within strain Y4001 to produce a Leu- and Ura- phenotype. Construct pY116 contained the following components:

TABLE 9

Description of Plasmid pY116 (SEQ ID NO: 323)

| RE Sites And Nucleotides Within SEQ ID NO: 323 | Description Of Fragment And Chimeric Gene Components |
|---|---|
| 1328-448 | ColE1 plasmid origin of replication |
| 2258-1398 | Ampicillin-resistance gene ($Amp^R$) for selection in *E. coli* |
| 3157-4461 | *Yarrowia* autonomous replication sequence (ARS18; GenBank Accession No. A17608) |
| SwaI/PacI 6667-4504 | *Yarrowia* Leu2 gene (GenBank Accession No. AF260230) |
| Swa I/Pme I (6667-218) | GPAT::Cre::XPR2, comprising: <br> GPAT: *Yarrowia lipolytica* GPAT promoter (U.S. Pat. No. 7,264,949); <br> Cre: Enterobacteria phage P1 Cre gene for recombinase protein (GenBank Accession No. X03453); <br> XPR2: ~100 bp of the 3' region of the *Yarrowia* Xpr gene (GenBank Accession No. M17741) |

Plasmid pY116 was used for transformation of freshly grown Y4001 cells according to the General Methods. The transformed cells were plated onto MMLeuUra plates containing 280 µg/mL sulfonylurea (chlorimuron ethyl, E. I. duPont de Nemours & Co., Inc., Wilmington, Del.), and plates were maintained at 30° C. for 3 to 4 days. Four colonies were picked and then used to inoculate 3 mL liquid YPD. The liquid cultures were shaken at 250 rpm/min for 1 day at 30° C. The cultures were diluted to 1:50,000 with liquid MMLeuUra media, and 100 µL were plated onto new YPD plates. The plates were maintained at 30° C. for 2 days. Colonies were picked and streaked onto MMLeu and MMLeuUra selection plates. The colonies that could grow on MMLeuUra plates but not on MMLeu plates were selected and analyzed by GC to confirm the presence of C20:2 (EDA). Several strains, each having a Leu- and Ura- phenotype, produced about 17% EDA of total lipids and collectively, were designated as Y4001U. One of these strains was designated as Y4001U1.

Generation Of Y4036 Strain To Produce About 18% DGLA Of Total Lipids:

Construct pKO2UF8289 (FIG. 46A; SEQ ID NO:324) was generated to integrate four chimeric genes (comprising a delta-12 desaturase, one delta-9 elongase, and two mutant delta-8 desaturases) into the delta-12 loci of strain Y4001U1, to thereby enable production of DGLA. Construct pKO2UF8289 contained the following components:

TABLE 10

Description of Plasmid pKO2UF8289 (SEQ ID NO: 324)

| RE Sites And Nucleotides Within SEQ ID NO: 324 | Description Of Fragment And Chimeric Gene Components |
|---|---|
| AscI/BsiWI (10337-9600) | 5' portion of *Yarrowia* delta-12 desaturase gene (SEQ ID NO: 325) (labeled as "YLD12-N" in Figure; U.S. Pat. No. 7,214,491) |
| EcoRI/SphI (13601-13045) | 3' portion of *Yarrowia* delta-12 desaturase gene (SEQ ID NO: 325) (labeled as "YL12-C" in Figure; PCT Publication No. WO 2004/104167; U.S. Pat. No. 7,214,491) |
| SwaI/BsiWI (7088-9600) | FBAINm::EgD8M::Pex20, comprising:<br>FBAINm: *Yarrowia lipolytica* FBAINm promoter (PCT Publication No. WO 2005/049805; U.S. Pat. No. 7,202,356);<br>EgD8M: Synthetic mutant delta-8 desaturase (SEQ ID NO: 327) (labeled as "D8S-23" in Figure; U.S. Patent Application No. 11/635258), derived from *Euglena gracilis* ("EgD8S"; U.S. Pat. No. 7,256,033);<br>Pex20: Pex20 terminator sequence from *Yarrowia* Pex20 gene (GenBank Accession No. AF054613) |
| SwaI/PmeI (7088-4581) | YAT1::FmD12::OCT, comprising:<br>YAT1: *Yarrowia lipolytica* YAT1 promoter (labeled as "YAT" in Figure; Patent Publication No. US 2006/0094102-A1);<br>FmD12: *Fusarium moniliforme* delta-12 desaturase gene (SEQ ID NO: 316) (labeled as "F.D12" in Figure; PCT Publication No. WO 2005/047485);<br>OCT: OCT terminator sequence of *Yarrowia* OCT gene (GenBank Accession No. X69988) |
| PmeI/PacI (4581-2124) | EXP1::EgD8M::Pex16, comprising:<br>EXP1: *Yarrowia lipolytica* export protein (EXP1) promoter (PCT Publication No. WO 2006/052870 and U.S. Patent Application No. 11/265761);<br>EgD8M: Synthetic mutant delta-8 desaturase (SEQ ID NO: 327) (labeled as "D8-23" in Figure; U.S. Patent Application No. 11/635258), derived from *Euglena gracilis* ("EgD8S"; PCT Publication No. WO 2006/012326; U.S. Pat. No. 7,256,033);<br>Pex16: Pex16 terminator sequence from *Yarrowia* Pex16 gene (GenBank Accession No. U75433) |
| PmeI/ClaI (2038-1) | GPAT::EgD9e::Lip2, comprising:<br>GPAT: *Yarrowia lipolytica* GPAT promoter (PCT Publication No. WO 2006/031937; U.S. Pat. No. 7,264,949);<br>EgD9e: *Euglena gracilis* delta-9 elongase gene (SEQ ID NO: 329) (labeled as "EgD9E" in Figure; PCT Publication No. WO 2007/061742);<br>Lip2: Lip2 terminator sequence from *Yarrowia* Lip2 gene (GenBank Accession No. AJ012632) |
| ClaI/EcoRI (13601-1) | LoxP::Ura3::LoxP, comprising:<br>LoxP sequence (SEQ ID NO: 320);<br>*Yarrowia* Ura3 gene (GenBank Accession No. AJ306421);<br>LoxP sequence (SEQ ID NO: 320) |

The pKO2UF8289 plasmid was digested with AscI/SphI and then used for transformation of strain Y4001U1 according to the General Methods. The transformed cells were plated onto MMLeu plates, and plates were maintained at 30° C. for 2 to 3 days. The colonies were picked and streaked onto MMLeu selection plates at 30° C. for 2 days. These cells were then used to inoculate liquid MMLeu media, and liquid cultures were shaken at 250 rpm/min for 2 days at 30° C. The cells were collected by centrifugation, and lipids were extracted. Fatty acid methyl esters were prepared by transesterification and subsequently analyzed with a Hewlett-Packard 6890 GC.

GC analyses showed the presence of DGLA in the transformants containing the 4 chimeric genes of pKO2UF8289, but not in the parent Y4001U1 strain. Most of the selected 96 strains produced between 7% and 13% DGLA of total lipids. Six strains, designated as Y4034, Y4035, Y4036, Y4037, Y4038, and Y4039, produced about 15%, 13.8%, 18.2%, 13.1%, 15.6%, and 13.9% DGLA of total lipids, respectively.

Generation Of Strain Y4036U (Leu-, Ura3-):

Construct pY116 (FIG. 45B; SEQ ID NO:323) was utilized to temporarily express a Cre recombinase enzyme in strain Y4036. This released the LoxP sandwiched Ura3 gene from the genome.

Plasmid pY116 was used to transform strain Y4036 according to the General Methods. Following transformation, the cells were plated onto MMLeuUra plates, and plates were maintained at 30° C. for 2 to 3 days. The individual colonies grown on MMLeuUra plates were picked and streaked into YPD liquid media. Liquid cultures were shaken at 250 rpm/min for 1 day at 30° C. to cure the pY116 plasmid. Cells from the grown cultures were streaked on MMLeuUra plates. After two days at 30° C., the individual colonies were re-streaked on MMLeuUra, MMU and MMLeu plates. Those colonies that could grow on MMLeuUra, but not on MMU or MMLeu plates, were selected. One strain with Leu- and Ura- phenotypes was designated as Y4036U (Ura-, Leu-).

Generation Of Y4069 And Y4070 Strains To Produce About 12% ARA Of Total Lipids Construct pZKSL-555R (FIG. 46B; SEQ ID NO:331) was generated to integrate three delta-5 desaturase genes into the Lys loci of strain Y4036U, to thereby enable production of ARA. The pZKSL-555R plasmid contained the following components:

TABLE 11

Description of Plasmid pZKSL-555R (SEQ ID NO: 331)

| RE Sites And Nucleotides Within SEQ ID No: 331 | Description Of Fragment And Chimeric Gene Components |
|---|---|
| AscI/BsiWI (3321-2601) | 720 bp 5' portion of *Yarrowia* Lys5 gene (GenBank Accession No. M34929) |
| PacI/SphI (6716-6029) | 687 bp 3' portion of *Yarrowia* Lys5 gene (Gen Bank Accession No. M34929) |
| BglII/BsiWI (15-2601) | EXP1::EgD5S::Pex20, comprising:<br>EXP1: *Yarrowia lipolytica* export protein (EXP1) promoter (labeled as "EXP" in Figure; U.S. Patent Application No. 11/265761);<br>EgD5S: codon-optimized delta-5 desaturase (SEQ ID NO: 332), derived from *Euglena gracilis* (Patent Publication US 2007-0292924-A1);<br>Pex20: Pex20 terminator sequence from *Yarrowia* Pex20 gene (GenBank Accession No. AF054613) |
| ClaI/PmeI (11243-1) | YAT1::RD5S::OCT, comprising:<br>YAT1: *Yarrowia lipolytica* YAT1 promoter (labeled as "YAT" in Figure; Patent Publication US 2006/0094102-A1);<br>RD5S: codon-optimized delta-5 desaturase (SEQ ID NO: 334), derived from *Peridinium* sp. CCMP626 (labeled as "RD5S(626)" in Figure; Patent Publication US 2007-0271632-A1);<br>OCT: OCT terminator sequence of *Yarrowia* OCT gene (GenBank Accession No. X69988) |
| EcoRI/PacI (9500-6716) | FBAIN::EgD5::Aco, comprising:<br>FBAIN: *Yarrowia lipolytica* FBAIN promoter (U.S. Pat. No. 7,202,356);<br>EgD5: *Euglena gracilis* delta-5 desaturase (SEQ ID NO: 336) (labeled as "EgD5WT" in Figure; Patent Publication US 2007-0292924-A1) with elimination of internal EcoRI, BglII, HindIII and NcoI restriction enzyme sites [mutations labeled as "M.EI", "M.BII", "M.H" and "M.N", respectively];<br>Aco: Aco terminator sequence from *Yarrowia* Aco gene (GenBank Accession No. AJ001300) |
| EcoRI/ClaI (9500-11243) | *Yarrowia* Leu2 gene (GenBank Accession No. M37309) |

The pZKSL-555R plasmid was digested with AscI/SphI and then used for transformation of strain Y4036U according to the General Methods. The transformed cells were plated onto MMLeuLys plates, and plates were maintained at 30° C. for 2 to 3 days. Single colonies were then re-streaked onto MMLeuLys plates, and the resulting colonies were used to inoculate liquid MMLeuLys. Liquid cultures were then shaken at 250 rpm/min for 2 days at 30° C. The cells were collected by centrifugation, and lipids were extracted. Fatty acid methyl esters were prepared by trans-esterification and subsequently analyzed with a Hewlett-Packard 6890 GC.

GC analyses showed the presence of ARA in the transformants containing the 3 chimeric genes of pZKSL-555R, but not in the parent Y4036U strain. Most of the selected 96 strains produced ~10% ARA of total lipids. Four strains, designated as Y4068, Y4069, Y4070, and Y4071, produced about 11.7%, 11.8%, 11.9% and 11.7% ARA of total lipids, respectively. Further analyses showed that the three chimeric genes of pZKSL-555R were not integrated into the Lys5 site in the Y4068, Y4069, Y4070 and Y4071 strains. All strains possessed a Lys+phenotype.

The final genotype of strain Y4070, with respect to wild-type *Yarrowia lipolytica* ATCC #20362, was Ura-, unknown 1-, unknown 3-, Leu+, Lys+, GPD::FmD12::Pex20, YAT1:: FmD12::OCT, YAT1::ME3S::Pex16, GPAT::EgD9e::Lip2, EXP1::EgD9eS::Lip1, FBAINm::EgD9eS::Lip2, FBAINm:: EgD8M::Pex20, EXP1::EgD8M::Pex16, FBAIN::EgD5:: Aco, EXP1::EgD5S::Pex20, YAT1::RD5S::OCT.

Generation Of Y4086 Strain To Produce About 14% EPA Of Total Lipids:

Construct pZP3-Pa777U (FIG. 47A; SEQ ID NO:338) was generated to integrate three delta-17 desaturase genes into the Pox3 loci (GenBank Accession No. AJ001301) of strain Y4070, to thereby enable production of EPA. The pZP3-Pa777U plasmid contained the following components:

TABLE 12

Description of Plasmid pZP3-Pa777U (SEQ ID NO: 338)

| RE Sites And Nucleotides Within SEQ ID NO: 338 | Description Of Fragment And Chimeric Gene Components |
|---|---|
| AscI/BsiWI (3527-4297) | 770 bp 5' portion of *Yarrowia* Pox3 gene (GenBank Accession No. AJ001301) |
| PacI/SphI (1-827) | 827 bp 3' portion of *Yarrowia* Pox3 gene (GenBank Accession No. AJ001301) |
| ClaI/SwaWI (6624-4457) | YAT1::PaD17S::Lip1, comprising: YAT1: *Yarrowia lipolytica* YAT1 promoter (labeled as "YAT" in Figure; Patent Publication US 2006/0094102-A1); PaD17S: codon-optimized delta-17 desaturase (SEQ ID NO: 339), derived from *Pythium aphanidermatum* (U.S. Patent Application No. 11/779915); Lip1: Lip1 terminator sequence from *Yarrowia* Lip1 gene (GenBank Accession No. Z50020) |
| EcoRI/PmeI (8359-10611) | EXP1::PaD17::Pex16, comprising: EXP1: *Yarrowia lipolytica* export protein (EXP1) promoter (labeled as "Exp" in Figure; U.S. Patent Application No. 11/265761); PaD17: *Pythium aphanidermatum* delta-17 desaturase gene (SEQ ID NO: 341) (labeled as "PaD17WT" in Figure; U.S. Patent Application No. 11/779915); Pex16: Pex16 terminator sequence from *Yarrowia* Pex16 gene (GenBank Accession No. U75433) |

TABLE 12-continued

Description of Plasmid pZP3-Pa777U (SEQ ID NO: 338)

| RE Sites And Nucleotides Within SEQ ID NO: 338 | Description Of Fragment And Chimeric Gene Components |
|---|---|
| PmeI/PacI (10611-1) | FBAINm::PaD17::Aco, comprising: FBAINm: *Yarrowia lipolytica* FBAINm promoter (WO 2005/049805; U.S. Pat. No. 7,202,356); PaD17: *Pythium aphanidermatum* delta-17 desaturase gene (SEQ ID NO: 341) (labeled as "PaD17WT" in Figure; U.S. Patent Application No. 11/779915); Aco: Aco terminator sequence from *Yarrowia* Aco gene (GenBank Accession No. AJ001300) |
| ClaI/EcoRI (6624-8359) | LoxP::Ura3::LoxP, comprising: LoxP sequence (SEQ ID NO: 320); *Yarrowia* Ura3 gene (GenBank Accession No. AJ306421); LoxP sequence (SEQ ID NO: 320) |

The pZP3-Pa777U plasmid was digested with AscI/SphI and then used for transformation of strain Y4070 according to the General Methods. The transformed cells were plated onto MM plates, and plates were maintained at 30° C. for 2 to 3 days. Single colonies were then re-streaked onto MM plates, and the resulting colonies were used to inoculate liquid MMLeuLys. Liquid cultures were shaken at 250 rpm/min for 2 days at 30° C. The cells were collected by centrifugation, and lipids were extracted. Fatty acid methyl esters were prepared by trans-esterification and subsequently analyzed with a Hewlett-Packard 6890 GC.

GC analyses showed the presence of EPA in the transformants containing the 3 chimeric genes of pZP3-Pa777U, but not in the parent Y4070 strain. Most of the selected 96 strains produced 10-13% EPA of total lipids. Two strains, designated as Y4085 and Y4086, produced about 14.2% and 13.8% EPA of total lipids, respectively.

The final genotype of strain Y4086, with respect to wild-type *Yarrowia lipolytica* ATCC #20362, was Ura3+, Leu+, Lys+, unknown 1-, unknown 3-, YALI0F24167g-, GPD:: FmD12::Pex20, YAT1::FmD12::OCT, YAT1::ME3S::Pex16, GPAT::EgD9e::Lip2, EXP1::EgD9eS::Lip1, FBAINm:: EgD9eS::Lip2, FBAINm::EgD8M::Pex20, EXP1::EgD8M:: Pex16, FBAIN::EgD5::Aco, EXP1::EgD5S::Pex20, YAT1:: RD5S::OCT, YAT1::PaD17S::Lip1, EXP1::PaD17::Pex16, FBAINm::PaD17::Aco.

Generation Of Strain Y4086U1 (Ura3-):

Strain Y4086U1 was created via temporary expression of the Cre recombinase enzyme in construct pY117 (FIG. 47B; SEQ ID NO:343) within strain Y4086 to produce a Ura-phenotype. This released the LoxP sandwiched Ura3 gene from the genome. The mutated *Yarrowia* AHAS enzyme in plasmid pY117 conferred $SU^R$, which was used as a positive screening marker.

Plasmid pY117 was derived from plasmid pY116 (described supra, and in U.S. patent application Ser. No. 11/635, 258) by inserting the mutant AHAS gene flanked by PacI-SwaI sites into PacI-SwaI digested pY116, thereby replacing the LEU selectable marker with the sulfonylurea marker. Construct pY117 thereby contained the following components:

TABLE 13

Description of Plasmid pY117 (SEQ ID NO: 343)

| RE Sites And Nucleotides Within SEQ ID NO: 343 | Description Of Fragment And Chimeric Gene Components |
|---|---|
| 1328-448 | ColE1 plasmid origin of replication |
| 2258-1398 | Ampicillin-resistance gene (Amp$^R$) for selection in E. coli |
| 2438-2838 | E. coli f1 origin of replication |
| 3157-4461 | Yarrowia autonomous replication sequence (ARS18; GenBank Accession No. A17608) |
| PacI/SwaI 4504-7498 | Yarrowia lipolytica AHAS gene (GenBank Accession No. XP_501277) comprising a W497L mutation (SEQ ID NO: 344; PCT Publication No. WO 2006/052870) |
| SwaI/PmeI 7498-218 | GPAT::Cre::XPR, comprising: GPAT: Yarrowia lipolytica GPAT promoter (PCT Publication No. WO 2006/031937; U.S. Pat. No. 7,264,949); Cre: Enterobacteria phage P1 Cre gene for recombinase protein (GenBank Accession No. X03453) except for single base change (T4G) resulting in a single amino acid change (S2A) to create a NcoI site for cloning convenience; XPR: ~100 bp of the 3' region of the Yarrowia Xpr gene (GenBank Accession No. M17741) |

Plasmid pY117 was used to transform strain Y4086 according to the General Methods. Following transformation, the cells were plated onto MMU+SU (280 µg/mL sulfonylurea; also known as chlorimuron ethyl, E. I. duPont de Nemours & Co., Inc., Wilmington, Del.) plates, and plates were maintained at 30° C. for 2 to 3 days. The individual SU$^R$ colonies grown on MMU+SU plates were picked and streaked into YPD liquid media, and liquid cultures were shaken at 250 rpm/min for 1 day at 30° C. to cure the pY117 plasmid. Cells from the grown cultures were streaked onto MMU plates. After two days at 30° C., the individual colonies were re-streaked onto MM and MMU plates. Those colonies that could grow on MMU, but not on MM plates were selected. Two of these strains with Ura- phenotypes were designated as Y4086U1 and Y4086U2 (Ura-).

Generation of Y4128 Strain to Produce about 37% EPA of Total Lipids:

Construct pZP2-2988 (FIG. 48A; SEQ ID NO:345) was generated to integrate one delta-12 desaturase gene, two delta-8 desaturase genes, and one delta-9 elongase gene into the Pox2 loci (GenBank Accession No. AJ001300) of strain Y4086U1, to thereby enable higher level production of EPA. The pZP2-2988 plasmid contained the following components:

TABLE 14

Description of Plasmid pZP2-2988 (SEQ ID NO: 345)

| RE Sites And Nucleotides Within SEQ ID NO: 345 | Description Of Fragment And Chimeric Gene Components |
|---|---|
| AscI/BsiWI (3083-2273) | 803 bp 5' portion of Yarrowia Pox2 gene (GenBank Accession No. AJ001300) |
| PacI/SphI (6446-5791) | 649 bp 3' portion of Yarrowia Pox2 gene (GenBank Accession No. AJ001300) |
| PmeI/BsiWI (347-2273) | FBA::EgD9eS::Pex20, comprising: FBA: Yarrowia lipolytica FBA promoter (PCT Publication No. WO 2005/049805; U.S. Pat. No. 7,202,356); EgD9eS: codon-optimized delta-9 elongase (SEQ ID NO: 318), derived from Euglena gracilis (PCT Publication No. WO 2007/061742); Pex20: Pex20 terminator sequence from Yarrowia Pex20 gene (GenBank Accession No. AF054613) |
| ClaI/PmeI (13318-347) | GPM/FBAIN::FmD12S::OCT, comprising: GPM/FBAIN: chimeric Yarrowia lipolytica GPM/FBAIN promoter (separately labeled as "GPM" and "FBA intron" in Figure) (PCT Publication No. WO 2005/049805; U.S. Pat. No. 7,202,356); FmD12S: codon-optimized delta-12 desaturase (SEQ ID NO: 346), derived from Fusarium moniliforme (labeled as "F.D12S" in Figure; PCT Publication No. WO 2005/047485); OCT: OCT terminator sequence of Yarrowia OCT gene (GenBank Accession No. X69988) |
| ClaI/EcoRI (13318-11581) | LoxP::Ura3::LoxP, comprising: LoxP sequence (SEQ ID NO: 320); Yarrowia Ura3 gene (GenBank Accession No. AJ306421); LoxP sequence (SEQ ID NO: 320) |
| EcoRII/SwaI (11581-8884) | GPDIN::EgD8M::Lip1, comprising: GPDIN: Yarrowia lipolytica GPDIN promoter (Patent Publication US 2006/0019297-A1); EgD8M: Synthetic mutant delta-8 desaturase (SEQ ID NO: 327; U.S. Patent Application No. 11/635258), derived from Euglena gracilis ("EgD8S"; U.S. Pat. No. 7,256,033); Lip1: Lip1 terminator sequence from Yarrowia Lip1 gene (GenBank Accession No. Z50020) |
| SwaI/PacI (8884-6446) | YAT1::EgD8M::ACO, comprising: YAT1: Yarrowia lipolytica YAT1 promoter (labeled as "YAT" in Figure; Patent Publication US 2006/0094102-A1); EgD8M: Synthetic mutant delta-8 desaturase (SEQ ID NO: 327; U.S. Patent Application No. 11/635258), derived from Euglena gracilis ("EgD8S"; U.S. Pat. No. 7,256,033); Aco: Aco terminator sequence from Yarrowia Aco gene (GenBank Accession No. AJ001300) |

The pZP2-2988 plasmid was digested with AscI/SphI and then used for transformation of strain Y4086U1 according to the General Methods. The transformed cells were plated onto MM plates, and plates were maintained at 30° C. for 2 to 3 days. Single colonies were re-streaked onto MM plates, and the resulting colonies were used to inoculate liquid MMLeu-Lys. Liquid cultures were shaken at 250 rpm/min for 2 days at 30° C. The cells were collected by centrifugation, resuspended in HGM, and then shaken at 250 rpm/min for 5 days. The cells were collected by centrifugation, and lipids were extracted. Fatty acid methyl esters were prepared by transesterification and subsequently analyzed with a Hewlett-Packard 6890 GC.

GC analyses showed that most of the selected 96 strains produced 12-15.6% EPA of total lipids. Two strains, designated as Y4128 and Y4129, produced about 37.6% and 16.3% EPA of total lipids, respectively.

The final genotype of strain Y4128, with respect to wild-type Yarrowia lipolytica ATCC #20362, was: YALIOF24167g-, Pex10-, unknown 1-, unknown 2-, GPD::FmD12::Pex20, YAT1::FmD12::OCT, GPM/FBAIN::FmD12S::OCT, YAT1::ME3S::Pex16, GPAT::EgD9e::Lip2, EXP1::EgD9eS::Lip1, FBAINm::EgD9eS::Lip2, FBA::EgD9eS::Pex20, FBAINm::EgD8M::Pex20, EXP1::EgD8M::Pex16, GPDIN::EgD8M::Lip1, YAT1::EgD8M::Aco, FBAIN::EgD5::Aco, EXP1::EgD5S::Pex20, YAT1::

RD5S::OCT, YAT1::PaD17S::Lip1, EXP1::PaD17::Pex16, FBAINm::PaD17::Aco. *Yarrowia lipolytica* strain Y4128 was deposited with the American Type Culture Collection on Aug. 23, 2007 and bears the designation ATCC PTA-8614.

Generation Of Y4128U Strains: In order to disrupt the Ura3 gene in strain Y4128, construct pZKUE3S (FIG. 48B; SEQ ID NO:351) was created to integrate a EXP1::ME3S::Pex20 chimeric gene into the Ura3 gene of strain Y4128. Plasmid pZKUE3S contained the following components:

TABLE 15

Description of Plasmid pZKUE3S (SEQ ID NO: 351)

| RE Sites And Nucleotides Within SEQ ID NO: 351 | Description Of Fragment And Chimeric Gene Components |
|---|---|
| BsiWI/PacI (318-1038) | 721 bp 5' portion of *Yarrowia* Ura3 gene (GenBank Accession No. AJ306421) |
| SphI/PmeI (3915-4594) | 729 bp 3' portion of *Yarrowia* Ura3 gene (GenBank Accession No. AJ306421) |
| EcoRI/BsiWI (4628-318) | EXP1::ME3S::Pex20, comprising:<br>EXP1: *Yarrowia lipolytica* export protein (EXP1) promoter (labeled as "Exp" in Figure; U.S. Patent Application No. 11/265761);<br>ME3S: codon-optimized $C_{16/18}$ elongase gene (SEQ ID NO: 321), derived from *Mortierella alpina* (PCT Publication No. WO 2007/046817);<br>Pex20: Pex20 terminator sequence of *Yarrowia* Pex20 gene (GenBank Accession No. AF054613) |
| 2149-1269 | ColE1 plasmid origin of replication |
| 3079-2219 | ampicillin-resistance gene ($Amp^R$) for selection in *E. coli* |
| 3659-3259 | f1 origin |

Plasmid pZKUE3S was digested with SphI/PacI and then used to transform strain Y4128 according to the General Methods. Following transformation, cells were plated onto MM+5-FOA selection plates, and plates were maintained at 30° C. for 2 to 3 days.

A total of 24 transformants grown on MM+5-FOA selection plates were picked and re-streaked onto fresh MM+5-FOA plates. The cells were stripped from the plates, and lipids were extracted. Fatty acid methyl esters were prepared by trans-esterification and subsequently analyzed with a Hewlett-Packard 6890 GC.

GC analyses showed the presence of between 10-15% EPA in all of the transformants with pZKUE3S from plates. The strains designated as Y4128U1, Y4128U2, Y4128U3, Y4128U4, Y4128U5, and Y4128U6 produced 12.9%, 14.4%, 15.2%, 15.4%, 14%, and 10.9% EPA, respectively (collectively, Y4128U).

The discrepancy in the % EPA quantified in Y4128 (37.6%) versus Y4128U (average 13.8%) is based on differing growth conditions. Specifically, the former culture was analyzed following two days of growth in liquid culture, while the latter culture was analyzed after growth on an agar plate. The Applicants have observed a 2-3 fold increase in % EPA, when comparing results from agar plates to those in liquid culture. Thus, although results are not directly comparable, both Y4128 and Y4128U strains demonstrate high production of EPA.

Generation Of Y4217 Strain To Produce About 42% EPA Of Total Lipids:

Construct pZKL2-5U89GC (FIG. 49A; SEQ ID NO:348) was generated to integrate one delta-9 elongase gene, one delta-8 desaturase gene, one delta-5 desaturase gene, and one *Yarrowia lipolytica* diacylglycerol cholinephosphotransferase gene (CPT1) into the Lip2 loci (GenBank Accession No. AJ012632) of strain Y4128U3 to thereby enable higher level production of EPA. The pZKL2-5U89GC plasmid contained the following components:

TABLE 16

Description of Plasmid pZKL2-5U89GC (SEQ ID NO: 348)

| RE Sites And Nucleotides Within SEQ ID NO: 348 | Description Of Fragment And Chimeric Gene Components |
|---|---|
| AscI/BsiWI (730-1) | 722 bp 5' portion of *Yarrowia* Lip2 gene (labeled as "Lip2.5N" in Figure; GenBank Accession No. AJ012632) |
| PacI/SphI (4141-3438) | 697 bp 3' portion of *Yarrowia* Lip2 gene (labeled as "Lip2.3N" in Figure; GenBank Accession No. AJ012632) |
| SwaI/BsiWI (13382-1) | YAT1::YlCPT1::Aco, comprising:<br>YAT1: *Yarrowia lipolytica* YAT1 promoter (labeled as "YAT" in Figure; Patent Publication US 2006/0094102-A1);<br>YlCPT1: *Yarrowia lipolytica* diacylglycerol cholinephosphotransferase gene (SEQ ID NO: 349) (labeled as "CPT1" in Figure; PCT Publication No. WO 2006/052870);<br>Aco: Aco terminator sequence from *Yarrowia* Aco gene (GenBank Accession No. AJ001300) |
| PmeI/SwaI (10745-13382) | FBAIN::EgD8M::Lip1 comprising:<br>FBAIN: *Yarrowia lipolytica* FBAIN promoter (U.S. Pat. No. 7,202,356);<br>EgD8M: Synthetic mutant delta-8 desaturase (SEQ ID NO: 327) (labeled as "D8S-23" in Figure; U.S. Patent Application No. 11/635258), derived from *Euglena gracilis* ("EgD8S"; U.S. Pat. No. 7,256,033);<br>Lip1: Lip1 terminator sequence from *Yarrowia* Lip1 gene (GenBank Accession No. Z50020) |
| PmeI/ClaI (10745-8650) | GPD::EgD9eS::Lip2, comprising:<br>GPD: *Yarrowia lipolytica* GPD promoter (labeled as "GPD Pro" in Figure; U.S. Pat. No. 7,259,255);<br>EgD9eS: codon-optimized delta-9 elongase gene (SEQ ID NO: 318), derived from *Euglena gracilis* (labeled as "EgD9ES" in Figure; PCT Publication No. WO 2007/061742);<br>Lip2: Lip2 terminator sequence from *Yarrowia* Lip2 gene (GenBank Accession No. AJ012632) |
| ClaI/EcoRI (8650-6581) | *Yarrowia* Ura3 gene (GenBank Accession No. AJ306421) |
| EcoRI/PacI (6581-4141) | YAT1::EgDD5S::ACO, comprising:<br>YAT1: *Yarrowia lipolytica* YAT1 promoter (labeled as "YAT" in Figure; Patent Publication US 2006/0094102-A1);<br>EgD5S: codon-optimized delta-5 desaturase (SEQ ID NO: 332), derived from *Euglena gracilis* (Patent Publication US 2007-0292924-A1);<br>Aco: Aco terminator sequence from *Yarrowia* Aco gene (GenBank Accession No. AJ001300) |

The pZKL2-5U89GC plasmid was digested with AscI/SphI and then used for transformation of strain Y4128U3 according to the General Methods. The transformed cells were plated onto MM plates, and plates were maintained at 30° C. for 3 to 4 days. Single colonies were re-streaked onto MM plates, and the resulting colonies were then used to inoculate liquid MM. Liquid cultures were shaken at 250 rpm/min for 2 days at 30° C. The cells were collected by centrifugation, resuspended in HGM, and then shaken at 250 rpm/min for 5 days. The cells were collected by centrifugation, and lipids were extracted. Fatty acid methyl esters were prepared by trans-esterification and subsequently analyzed with a Hewlett-Packard 6890 GC.

GC analyses showed that most of the selected 96 strains produced 32-39.9% EPA of total lipids. Six strains, designated as Y4215, Y4216, Y4217, Y4218, Y4219 and Y4220, produced about 41.1%, 41.8%, 41.7%, 41.1%, 41% and 41.1% EPA of total lipids, respectively. The final genotype of each strain, with respect to wild type *Yarrowia lipolytica* ATCC #20362, was: YAL1C18711g-, Pex10-, YALI0F24167g-, unknown 1-, unknown 3-, GPD::FmD12::Pex20, YAT1::FmD12::OCT, GPM/FBAIN::FmD12S::OCT, YAT1::ME3S::Pex16, EXP1::ME3S::Pex20, GPAT::EgD9e::Lip2, EXP1::EgD9eS::Lip1, FBAINm::EgD9eS::Lip2, FBA::EgD9eS::Pex20, GPD::EgD9eS::Lip2, FBAINm::EgD8M::Pex20, FBAIN::EgD8M::Lip1, EXP1::EgD8M::Pex16, GPDIN::EgD8M::Lip1, YAT1::EgD8M::Aco, FBAIN::EgD5::Aco, EXP1::EgD5S::Pex20, YAT1::EgD5S::Aco, YAT1::RD5S::OCT, YAT1::PaD17S::Lip1, EXP1::PaD17::Pex16, FBAINm::PaD17::Aco, YAT1::YICPT1::ACO.

Generation Of Strain Y4217U2 (Ura3-):

In order to disrupt the Ura3 gene in strain Y4217, construct pZKUE3S (FIG. 48B; SEQ ID NO:351) was used to integrate a chimeric EXP1::ME3S::Pex20 gene into the Ura3 gene of strain Y4217. Following transformation, cells were plated onto MM+5-FOA selection plates, and plates were maintained at 30° C. for 3 to 4 days.

A total of 6 transformants grown on MM+5-FOA plates were picked and re-streaked onto MM plates and MM+5-FOA plates. All 6 strains had a Ura- phenotype (i.e., cells could grow on MM+5-FOA plates, but not on MM plates). The cells were scraped from the MM+5-FOA plates, and lipids were extracted. Fatty acid methyl esters were prepared by trans-esterification and subsequently analyzed with a Hewlett-Packard 6890 GC.

GC analyses showed the presence of 18.7% to 28.6% EPA in all of the transformants with pZKUE3S grown on MM+5-FOA plates. Two strains, designated as strains Y4217U1 and Y4217U2, produced 22.5% and 28.6% EPA, respectively.

Generation Of Y4259 Strain To Produce About 46.5% EPA Of Total Lipids:

Construct pZKL1-2SP98C (FIG. 49B; SEQ ID NO:352) was generated to integrate one delta-9 elongase gene, one delta-8 desaturase gene, one delta-12 desaturase gene, and one *Yarrowia lipolytica* diacylglycerol cholinephosphotransferase gene (CPT1) into the Lip1 loci (GenBank Accession No. Z50020) of strain Y4217U2, to thereby enable higher level production of EPA. The pZKL1-2SP98C plasmid contained the following components:

TABLE 17

Description of Plasmid pZKL1-2SP98C (SEQ ID NO: 352)

| RE Sites And Nucleotides Within SEQ ID NO: 352 | Description Of Fragment And Chimeric Gene Components |
|---|---|
| AscI/BsiWI (3474-2658) | 809 bp 5' portion of *Yarrowia* Lip1 gene (labeled as "Lip1-5'N" in Figure; GenBank Accession No. Z50020) |
| PacI/SphI (6951-6182) | 763 bp 3' portion of *Yarrowia* Lip1 gene (labeled as "Lip1.3N" in Figure; GenBank Accession No. Z50020) |
| SwaI/BsiWI (1-2658) | GPD::YICPT1::Aco, comprising: GPD: *Yarrowia lipolytica* GPD promoter (U.S. Pat. No. 7,259,255); YICPT1: *Yarrowia lipolytica* diacylglycerol cholinephosphotransferase gene (SEQ ID NO: 349) (labeled as "CPT1" in Figure; PCT Publication No. WO 2006/052870); Aco: Aco terminator sequence from *Yarrowia* Aco gene (GenBank Accession No. AJ001300) |
| PmeI/SwaI (13241-1) | FBAIN::EgD8M::Lip1 comprising: FBAIN: *Yarrowia lipolytica* FBAIN promoter (U.S. Pat. No. 7,202,356); EgD8M: Synthetic mutant delta-8 desaturase (SEQ ID NO: 327; U.S. Patent Application No. 11/635258), derived from *Euglena gracilis* |

TABLE 17-continued

Description of Plasmid pZKL1-2SP98C (SEQ ID NO: 352)

| RE Sites And Nucleotides Within SEQ ID NO: 352 | Description Of Fragment And Chimeric Gene Components |
|---|---|
| | ("EgD8S"; U.S. Pat. No. 7,256,033); Lip1: Lip1 terminator sequence from *Yarrowia* Lip1 gene (GenBank Accession No. Z50020) |
| PmeI/ClaI (13241-11385) | YAT1::EgD9eS::Lip2, comprising: YAT1: *Yarrowia lipolytica* YAT1 promoter (labeled as "YAT" in Figure; Patent Publication US 2006/0094102-A1); EgD9eS: codon-optimized delta-9 elongase gene (SEQ ID NO: 318), derived from *Euglena gracilis* (labeled as "EgD9ES" in Figure; PCT Publication No. WO 2007/061742); Lip2: Lip2 terminator sequence from *Yarrowia* Lip2 gene (GenBank Accession No. AJ012632) |
| ClaI/EcoRI (11385-9648) | LoxP::Ura3::LoxP, comprising: LoxP sequence (SEQ ID NO: 320); *Yarrowia* Ura3 gene (GenBank Accession No. AJ306421); LoxP sequence (SEQ ID NO: 320) |
| EcoRI/PacI (9648-6951) | EXP1::FmD12S::ACO, comprising: EXP1: *Yarrowia lipolytica* export protein (EXP1) promoter (labeled as "Exp" in Figure; U.S. Patent Application No. 11/265761); FmD12S: codon-optimized delta-12 elongase (SEQ ID NO: 346), derived from *Fusarium moniliforme* (labeled as "FD12S" in Figure; PCT Publication No. WO 2005/047485); Aco: Aco terminator sequence from *Yarrowia* Aco gene (GenBank Accession No. AJ001300) |

The pZKL1-2SP98C plasmid was digested with AscI/SphI and then used for transformation of strain Y4217U2 according to the General Methods. The transformed cells were plated onto MM plates, and plates were maintained at 30° C. for 3 to 4 days. Single colonies were re-streaked onto MM plates, and the resulting colonies were then used to inoculate liquid MM. The liquid cultures were then shaken at 250 rpm/min for 2 days at 30° C. The cells were collected by centrifugation, resuspended in HGM, and then shaken at 250 rpm/min for 5 days. The cells were collected by centrifugation, and lipids were extracted. Fatty acid methyl esters were prepared by trans-esterification and subsequently analyzed with a Hewlett-Packard 6890 GC.

GC analyses showed that most of the selected 72 strains produced 40-44% EPA of total lipids. Six strains, designated as Y4259, Y4260, Y4261, Y4262, Y4263, and Y4264, produced about 46.5%, 44.5%, 44.5%, 44.8%, 44.5%, and 44.3% EPA of total lipids, respectively.

The final genotype of strain Y4259 with respect to wild type *Yarrowia lipolytica* ATCC #20362 was: YALI0C18711g-, Pex10-, YALI0F24167g-, unknown 1-, unknown 3-, unknown 8-, GPD::FmD12::Pex20, YAT1::FmD12::OCT, GPM/FBAIN::FmD12S::OCT, EXP1::FmD12S::Aco, YAT1::ME3S::Pex16, EXP1::ME3S::Pex20 (2 copies), GPAT::EgD9e::Lip2, EXP1::EgD9eS::Lip1, FBAINm::EgD9eS::Lip2, FBA::EgD9eS::Pex20, GPD::EgD9eS::Lip2, YAT1::EgD9eS::Lip2, FBAINm::EgD8M::Pex20, FBAIN::EgD8M::Lip1 (2 copies), EXP1::EgD8M::Pex16, GPDIN::EgD8M::Lip1, YAT1::EgD8M::Aco, FBAIN::EgD5::Aco, EXP1::EgD5S::Pex20, YAT1::EgD5S::Aco, YAT1::RD5S::OCT, YAT1::PaD17S::Lip1, EXP1::PaD17::Pex16, FBAINm::PaD17::Aco, YAT1::YICPT1::ACO, GPD::YICPT1::ACO.

Generation Of Strain Y4259U2 (Ura3-):

In order to disrupt the Ura3 gene in Y4259 strain, construct pZKUM (FIG. 50A; SEQ ID NO:353) was used to integrate a Ura3 mutant gene into the Ura3 gene of strain Y4259. The plasmid pZKUM contained the following components:

TABLE 18

Description of Plasmid pZKUM (SEQ ID NO: 353)

| RE Sites And Nucleotides Within SEQ ID NO: 353 | Description Of Fragment And Chimeric Gene Components |
|---|---|
| SalI/PacI (32845-1) | Synthetic mutant Ura3 gene (SEQ ID NO: 354, wherein the 1459 bp DNA fragment contains a 33 bp deletion from +21 to +53, a 1 bp deletion at +376 and a 3 bp deletion from +400 to +403 of the *Yarrowia* Ura3 coding region (GenBank Accession No. AJ306421)) |
| 1112-232 | ColE1 plasmid origin of replication |
| 2042-1182 | Ampicillin-resistance gene (Amp$^R$) for selection in *E. coli* |

A total of 3 transformants grown on MM+5-FOA plates were picked and re-streaked onto MM plates and MM+5-FOA plates. All 3 strains had a Ura- phenotype (i.e., cells could grow on MM+5-FOA plates, but not on MM plates). The cells were scraped from the MM+5-FOA plates, and lipids were extracted. Fatty acid methyl esters were prepared by trans-esterification and subsequently analyzed with a Hewlett-Packard 6890 GC.

GC analyses showed the presence of 31.4%, 31% and 31.3% EPA in the #1, #2 and #3 transformants with pZKUM grown on MM+5-FOA plates. These three strains were designated as strains Y4259U1, Y4259U2 and Y4259U3, respectively (collectively, Y4259U).

Generation Of Y4305 Strain To Produce About 53% EPA Of Total Lipids:

Construct pZKD2-5U89A2 (FIG. 50B; SEQ ID NO:355) was generated to integrate one delta-9 elongase gene, one delta-5 desaturase gene, one delta-8 desaturase gene, and one delta-12 desaturase gene into the diacylglycerol acyltransferase (DGAT2) loci of strain Y4259U2, to thereby enable higher level production of EPA. The pZKD2-5U89A2 plasmid contained the following components:

TABLE 19

Description of Plasmid pZKD2-5U89A2 (SEQ ID NO: 355)

| RE Sites And Nucleotides Within SEQ ID NO: 355 | Description Of Fragment And Chimeric Gene Components |
|---|---|
| AscI/BsiWI (1-736) | 728 bp 5' portion of *Yarrowia* DGAT2 gene (SEQ ID NO: 356) (labeled as "YLDGAT5'" in Figure; U.S. Pat. No. 7,267,976) |
| PacI/SphI (4164-3444) | 714 bp 3' portion of *Yarrowia* DGAT2 gene (SEQ ID NO: 356) (labeled as "YLDGAT3'" in Figure; U.S. Pat. No. 7,267,976) |
| SwaI/BsiWI (13377-1) | YAT1::FmD12S::Lip2, comprising: YAT1: *Yarrowia lipolytica* YAT1 promoter (labeled as "YAT" in Figure; Patent Publication US 2006/0094102-A1); FmD12S: codon-optimized delta-12 elongase (SEQ ID NO: 346), derived from *Fusarium moniliforme* (labeled as "F.D12S" in Figure; PCT Publication No. WO 2005/047485); Lip2: Lip2 terminator sequence from *Yarrowia* Lip2 gene (GenBank Accession No. AJ012632) |

TABLE 19-continued

Description of Plasmid pZKD2-5U89A2 (SEQ ID NO: 355)

| RE Sites And Nucleotides Within SEQ ID NO: 355 | Description Of Fragment And Chimeric Gene Components |
|---|---|
| PmeI/SwaI (10740-13377) | FBAIN::EgD8M::Lip1 comprising: FBAIN: *Yarrowia lipolytica* FBAIN promoter (U.S. Pat. No. 7,202,356); EgD8M: Synthetic mutant delta-8 desaturase (SEQ ID NO: 327; U.S. Patent Application No. 11/635258), derived from *Euglena gracilis* ("EgD8S"; U.S. Pat. No. 7,256,033); Lip1: Lip1 terminator sequence from *Yarrowia* Lip1 gene (GenBank Accession No. Z50020) |
| ClaI/PmeI (8846-10740) | YAT1::E389D9eS::OCT, comprising: YAT1: *Yarrowia lipolytica* YAT1 promoter (labeled as "YAT" in Figure; Patent Publication US 2006/0094102-A1); E389D9eS: codon-optimized delta-9 elongase (SEQ ID NO: 358), derived from *Eutreptiella* sp. CCMP389 (labeled as "D9ES-389" in Figure; PCT Publication No. WO 2007/061742); OCT: OCT terminator sequence from *Yarrowia* OCT gene (GenBank Accession No. X69988) |
| ClaI/EcoRI (8846-6777) | *Yarrowia* Ura3 gene (GenBank Accession No. AJ306421) |
| EcoRI/PacI (6777-4164) | EXP1::EgD5S::ACO, comprising: EXP1: *Yarrowia lipolytica* export protein (EXP1) promoter (labeled as "Exp" in Figure; U.S. Patent Application No. 11/265761); EgD5S: codon-optimized delta-5 desaturase (SEQ ID NO: 332), derived from *Euglena gracilis* (Patent Publication US 2007-0292924-A1); Aco: Aco terminator sequence from *Yarrowia* Aco gene (GenBank Accession No. AJ001300) |

The pZKD2-5U89A2 plasmid was digested with AscI/SphI and then used for transformation of strain Y4259U2 according to the General Methods. The transformed cells were plated onto MM plates, and plates were maintained at 30° C. for 3 to 4 days. Single colonies were re-streaked onto MM plates, and the resulting colonies were used to inoculate liquid MM. Liquid cultures were shaken at 250 rpm/min for 2 days at 30° C. The cells were collected by centrifugation, resuspended in HGM, and then shaken at 250 rpm/min for 5 days. The cells were collected by centrifugation, and lipids were extracted. Fatty acid methyl esters were prepared by trans-esterification and subsequently analyzed with a Hewlett-Packard 6890 GC.

GC analyses showed that most of the selected 96 strains produced 40-46% EPA of total lipids. Four strains, designated as Y4305, Y4306, Y4307 and Y4308, produced about 53.2%, 46.4%, 46.8%, and 47.8% EPA of total lipids, respectively. The complete lipid profile of Y4305 is as follows: 16:0 (2.8%), 16:1 (0.7%), 18:0 (1.3%), 18:1 (4.9%), 18:2 (17.6%), ALA (2.3%), EDA (3.4%), DGLA (2.0%), ARA (0.6%), ETA (1.7%), and EPA (53.2%). The total lipid % dry cell weight (dcw) was 27.5.

The final genotype of strain Y4305 with respect to wild type *Yarrowia lipolytica* ATCC #20362 was SCP2- (YALI0E01298g), YALI0C18711g-, Pex10-, YALI0F24167g-, unknown 1-, unknown 3-, unknown 8-, GPD::FmD12::Pex20, YAT1::FmD12::OCT, GPM/FBAIN:: FmD12S::OCT, EXP1::FmD12S::Aco, YAT1::FmD12S:: Lip2, YAT1::ME3S::Pex16, EXP1::ME3S::Pex20 (3 copies), GPAT::EgD9e::Lip2, EXP1::EgD9eS::Lip1, FBAINm:: EgD9eS::Lip2, FBA::EgD9eS::Pex20, GPD::EgD9eS::Lip2, YAT1::EgD9eS::Lip2, YAT1::E389D9eS::OCT, FBAINm:: EgD8M::Pex20, FBAIN::EgD8M::Lip1 (2 copies), EXP1:: EgD8M::Pex16, GPDIN::EgD8M::Lip1, YAT1::EgD8M::

Aco, FBAIN::EgD5::Aco, EXP1::EgD5S::Pex20, YAT1:: EgD5S::Aco, EXP1::EgD5S::ACO, YAT1::RD5S::OCT, YAT1::PaD17S::Lip1, EXP1::PaD17::Pex16, FBAINm:: PaD17::Aco, YAT1::YICPT1::ACO, GPD::YICPT1::ACO.

Generation Of Strain Y4305U3 (Ura3-): In order to disrupt the Ura3 gene in strain Y4305, construct pZKUM (FIG. 50A; SEQ ID NO:353) was used to integrate a Ura3 mutant gene into the Ura3 gene of strain Y4305. A total of 8 transformants grown on MM+5-FOA plates were picked and re-streaked onto MM plates and MM+5-FOA plates, separately. All 8 strains had a Ura- phenotype (i.e., cells could grow on MM+5-FOA plates, but not on MM plates). The cells were scraped from the MM+5-FOA plates, and lipids were extracted. Fatty acid methyl esters were prepared by transesterification and subsequently analyzed with a Hewlett-Packard 6890 GC.

GC analyses showed the presence of 37.6%, 37.3% and 36.5% EPA in pZKUM transformants #1, #6 and #7 grown on MM+5-FOA plates. These three strains were designated as strains Y4305U1, Y4305U2 and Y4305U3, respectively (collectively, Y4305U).

Construction of *Yarrowia lipolytica* Strain Y4184U

*Y. lipolytica* strain Y4184U was used as the host in Examples 32, 33, 34 and 51, infra. Strain Y4184U was derived from *Y. lipolytica* ATCC #20362, and is capable of producing about 31% EPA relative to the total lipids via expression of a delta-9 elongase/delta-8 desaturase pathway.

The development of strain Y4184U required the construction of strain Y2224, strain Y4001, strain Y4001U, strain Y4036, strain Y4036U and strain Y4069 (supra). Further development of strain Y4184U (diagrammed in FIG. 51A) required construction of strain Y4084 (producing 14% EPA), strain Y4084U1 (Ura-), strain Y4127 (producing 18% EPA), strain Y4127U2 (Ura-), strain Y4158 (producing 25% EPA), strain Y4158U1 (Ura-), and strain 4184 (producing 30.7% EPA). Although the details concerning transformation and selection of the EPA-producing strains developed after strain Y4069 will not be elaborated herein, the methodology used for isolation of strain Y4084, strain Y4084U1, strain Y4127, strain Y4127U2, strain Y4158, strain Y4158U1, strain Y4184, and strain Y4184U was as described during construction of strain Y4305, supra.

Briefly, construct pZP3-Pa777U (FIG. 47A; SEQ ID NO:338) was utilized to integrate three delta-17 desaturase genes into the Pox3 loci (GenBank Accession No. AJ001301) of strain Y4069, thereby resulting in isolation of strain Y4084 (producing 14% EPA). Strain Y4084U1 was created via temporary expression of the Cre recombinase enzyme in construct pY117 (FIG. 47B; SEQ ID NO:343) within strain Y4084 to produce a Ura- phenotype. Construct pZP2-2988 (FIG. 48A; SEQ ID NO:345) was then utilized to integrate one delta-12 desaturase gene, two delta-8 desaturase genes, and one delta-9 elongase gene into the Pox2 loci (GenBank Accession No. AJ001300) of strain Y4084U1, thereby resulting in isolation of strain Y4127 (producing 18% EPA). *Yarrowia lipolytica* strain Y4127 was deposited with the American Type Culture Collection on Nov. 29, 2007 and bears the designation ATCC PTA-8802.

Strain Y4127U2 was created by disrupting the Ura3 gene in strain Y4127 via construct pZKUE3S (FIG. 48B; SEQ ID NO:351), comprising a chimeric EXP1::ME3S::Pex20 gene targeted for the Ura3 gene. Construct pZKL1-2SP98C (FIG. 49B; SEQ ID NO:352) was utilized to integrate one delta-9 elongase gene, one delta-8 desaturase gene, one delta-12 desaturase gene, and one *Yarrowia lipolytica* diacylglycerol cholinephosphotransferase gene (CPT1) into the Lip1 loci (GenBank Accession No. Z50020) of strain Y4127U2, thereby resulting in isolation of strain Y4158 (producing 25% EPA). A Ura- derivative (i.e., strain Y4158U1) was then created, via transformation with construct pZKUE3S (FIG. 48B; SEQ ID NO:351), comprising a chimeric EXP1::ME3S:: Pex20 gene targeted for the Ura3 gene. Finally, construct pZKL2-5U89GC (FIG. 49A; SEQ ID NO:348) was utilized to integrate one delta-9 elongase gene, one delta-8 desaturase gene, one delta-5 desaturase gene, and one *Yarrowia lipolytica* CPT1 into the Lip2 loci (GenBank Accession No. AJ012632) of Y4158U1, thereby resulting in isolation of strain Y4184.

The complete lipid profile of strain Y4184 is as follows: 16:0 (3.1%), 16:1 (1.5%), 18:0 (1.8%), 18:1 (8.7%), 18:2 (31.5%), ALA (4.9%), EDA (5.6%), DGLA (2.9%), ARA (0.6%), ETA (2.4%), and EPA (28.9%). The total lipid % dry cell weight (dcw) was 23.9.

The final genotype of strain Y4184 with respect to wildtype *Yarrowia lipolytica* ATCC #20362 was unknown 1-, unknown 2-, unknown 4-, unknown 5-, unknown 6-, unknown 7-, YAT1::ME3S::Pex16, EXP1::ME3S::Pex20 (2 copies), GPAT::EgD9e::Lip2, FBAINm::EgD9eS::Lip2, EXP1::EgD9eS::Lip1, FBA::EgD9eS::Pex20, YAT1:: EgD9eS::Lip2, GPD::EgD9eS::Lip2, GPDIN::EgD8M:: Lip1, YAT1::EgD8M::Aco, EXP1::EgD8M::Pex16, FBAINm::EgD8M::Pex20, FBAIN::EgD8M::Lip1 (2 copies), GPM/FBAIN::FmD12S::Oct, EXP1::FmD12S::Aco, YAT1::FmD12::Oct, GPD::FmD12::Pex20, EXP1::EgD5S:: Pex20, YAT1::EgD5S::Aco, YAT1::Rd5S::Oct, FBAIN:: EgD5::Aco, FBAINm::PaD17::Aco, EXP1::PaD17::Pex16, YAT1::PaD17S::Lip1, YAT1::YICPT1::Aco, GPD:: YICPT1::Aco.

In order to disrupt the Ura3 gene in strain Y4184, construct pZKUM (FIG. 50A; SEQ ID NO:353) was used to integrate a Ura3 mutant gene into the Ura3 gene of strain Y4184.

A total of 11 transformants grown on MM+5-FOA plates were picked and re-streaked onto MM plates and MM+5-FOA plates, separately. All 11 strains had a Ura- phenotype (i.e., cells could grow on MM+5-FOA plates, but not on MM plates). The cells were scraped from the MM+5-FOA plates; lipids were extracted; and fatty acid methyl esters were prepared by trans-esterification and subsequently analyzed with a Hewlett-Packard 6890 GC.

GC analyses showed the presence of 11.2%, 10.6%, and 15.5% EPA in the #7, #8 and #10 transformants with pZKUM grown on MM+5-FOA plates. These three strains were designated as strains Y4184U1, Y4184U2 and Y4184U4, respectively (collectively, Y4184U).

Example 1

*Euglena gracilis* Growth Conditions, Lipid Profile and mRNA Isolation

*Euglena gracilis* was obtained from Dr. Richard Triemer's lab at Michigan State University (East Lansing, Mich.). From 10 mL of actively growing culture, a 1 mL aliquot was transferred into 250 mL of *Euglena gracilis* (Eg) Medium in a 500 mL glass bottle. Eg medium was made by combining 1g of sodium acetate, 1 g of beef extract (Cat. No. U126-01, Difco Laboratories, Detroit, Mich.), 2 g of Bacto® tryptone (0123-17-3, Difco Laboratories), and 2 g of Bacto® yeast extract (Cat. No. 0127-17-9, Difco Laboratories) in 970 mL of water. After filter sterilizing, 30 mL of soil-water supernatant (Cat. No. 15-3790, Carolina Biological Supply Company, Burlington, N.C.) were aseptically added to produce the final Eg medium. *Euglena gracilis* cultures were grown at 23° C. with a 16 h light, 8 h dark cycle for 2 weeks with no agitation.

After 2 weeks, 10 mL of culture were removed for lipid analysis and centrifuged at 1,800×g for 5 min. The pellet was washed once with water and re-centrifuged. The resulting pellet was dried for 5 min under vacuum, resuspended in 100 µL of trimethylsulfonium hydroxide (TMSH), and incubated at room temperature for 15 min with shaking. After this, 0.5 mL of hexane were added, and the vials were incubated for 15 min at room temperature with shaking. Fatty acid methyl esters (5 µL injected from hexane layer) were separated and quantified using a Hewlett-Packard 6890 Gas Chromatograph fitted with an Omegawax 320 fused silica capillary column (Supelco Inc., Cat. No. 24152). The oven temperature was programmed to hold at 220° C. for 2.7 min, increase to 240° C. at 20° C./min, and then hold for an additional 2.3 min. Carrier gas was supplied by a Whatman hydrogen generator. Retention times were compared to those for methyl esters of standards commercially available (Nu-Chek Prep, Inc. Cat. No. U-99-A), and the resulting chromatogram is shown in FIG. 27.

The remaining 2 week culture (240 mL) was pelleted by centrifugation at 1,800×g for 10 min, washed once with water, and re-centrifuged. Total RNA was extracted from the resulting pellet using the RNA STAT-60™ reagent (TEL-TEST, Inc., Friendswood, Tex.) and following the manufacturer's protocol provided (use 5 mL of reagent, dissolved RNA in 0.5 mL of water). In this way, 1 mg of total RNA (2 mg/mL) was obtained from the pellet. The mRNA was isolated from 1 mg of total RNA using the mRNA Purification Kit (Amersham Biosciences, Piscataway, N.J.) following the manufacturer's protocol provided. In this way, 85 µg of mRNA were obtained.

Example 2

*Euglena gracilis* cDNA Synthesis, Library Construction and Sequencing

A cDNA library was generated using the Cloneminer™ cDNA Library Construction Kit (Cat. No. 18249-029, Invitrogen Corporation, Carlsbad, Calif.) and following the manufacturer's protocol provided (Version B, 25-0608). Using the non-radiolabeling method, cDNA was synthesized from 3.2 µg of mRNA (described above) using the Biotin-attB2-Oligo (dT) primer. After synthesis of the first and second strand, the attB1 adapter was added; ligation was performed; and the cDNA was size fractionated using column chromatography. DNA from fractions 7 and 8 (size ranging from ~800-1500 bp) were concentrated, recombined into PDONR™222, and transformed into *E. coli* ElectroMAX™ DH10B™ T1 Phage-Resistant cells (Invitrogen Corporation). The *Euglena gracilis* library was named eeg1c.

For sequencing, clones first were recovered from archived glycerol cultures grown/frozen in 384-well freezing media plates. Using an automatic QPix colony picker (Genetix), cells were picked and then used to inoculate 96-well deep-well plates containing LB+50 µg/mL kanamycin. After growing 20 h at 37° C., cells were pelleted by centrifugation and stored at −20° C. Plasmids then were isolated on an Eppendorf 5Prime robot, using a modified 96-well format alkaline lysis miniprep method (Eppendorf PerfectPrep). Briefly, a filter and vacuum manifold were used to facilitate removal of cellular debris after acetate precipitation. Plasmid DNA was then bound on a second filter plate directly from the filtrate, washed, dried, and eluted.

Plasmids were end-sequenced in 384-well plates, using vector-primed M13F Universal primer (SEQ ID NO:1) and the ABI BigDye version 3 Prism sequencing kit. For the sequencing reaction, 100-200 ng of template and 6.4 pmol of primer were used, and the following reaction conditions were repeated 25 times: 96° C. for 10 sec, 50° C. for 5 sec and 60° C. for 4 min. After ethanol-based cleanup, cycle sequencing reaction products were resolved and detected on Perkin-Elmer ABI 3700 automated sequencers.

Example 3

Identification of C20-PUFA Elongating Enzyme Homologs from *Euglena gracilis* cDNA Library eeg1c cDNA clones encoding C20-PUFA elongating enzyme homologs (i.e., "C20-PUFA Elo") were identified by conducting BLAST (Basic Local Alignment Search Tool; Altschul et al., *J. Mol. Biol.* 215:403-410 (1993)) searches for similarity to sequences contained in the BLAST "nr" database (comprising all non-redundant GenBank CDS translations, sequences derived from the 3-dimensional structure Brookhaven Protein Data Bank, the last major release of the SWISS-PROT protein sequence database, EMBL and DDBJ databases). The cDNA sequences obtained in Example 2 were analyzed for similarity to all publicly available DNA sequences contained in the "nr" database using the BLASTN algorithm provided by the National Center for Biotechnology Information (NCBI). The DNA sequences were translated in all reading frames and compared for similarity to all publicly available protein sequences contained in the "nr" database using the BLASTX algorithm (Gish and States, *Nat. Genet.* 3:266-272 (1993)) provided by the NCBI. For convenience, the P-value (probability) of observing a match of a cDNA sequence to a sequence contained in the searched databases merely by chance as calculated by BLAST are reported herein as "pLog" values, which represent the negative of the logarithm of the reported P-value. Accordingly, the greater the pLog value, the greater the likelihood that the cDNA sequence and the BLAST "hit" represent homologous proteins.

The BLASTX search using the nucleotide sequences from clone eeg1c.pk005.p14.f revealed similarity of the protein encoded by the cDNA to the C20-PUFA Elo from *Pavlova* sp. CCMP459 (SEQ ID NO:2) (NCBI Accession No. AAV33630 (GI 54307108), locus AAV33630, CDS AY630573; Pereira et al., *Biochem. J.* 384:357-366 (2004)). The sequence of a portion of the cDNA insert from clone eeg1c.pk005.p14.f is shown in SEQ ID NO:3 (5' end of cDNA insert). Subsequently, the full insert sequence (i.e., eeg1c.pk005.p14.f:fis) was obtained and is shown in SEQ ID NO:4. Sequence for the coding sequence (CDS) is shown in SEQ ID NO:5. Sequence for the corresponding deduced amino acid sequence is shown in SEQ ID NO:6.

Full insert sequencing (FIS) was carried out using a modified transposition protocol. Clones identified for FIS were recovered from archived glycerol stocks as single colonies, and plasmid DNA was isolated via alkaline lysis. Plasmid templates were transposed via the Template Generation System (TGS II) transposition kit (Finnzymes Oy, Espoo, Finland), following the manufacturer's protocol. The transposed DNA was transformed into EH10B electro-competent cells (Edge BioSystems, Gaithersburg, Md.) via electroporation. Multiple transformants were randomly selected from each transposition reaction, plasmid DNA was prepared, and templates were sequenced as above (ABI BigDye v3.1) outward from the transposition event site, utilizing unique primers SeqE (SEQ ID NO:7) and SeqW (SEQ ID NO:8).

Sequence data was collected (ABI Prism Collections software) and assembled using the Phrap sequence assembly program (P. Green, University of Washington, Seattle). Assemblies were viewed by the Consed sequence editor (D. Gordon, University of Washington, Seattle) for final editing.

The amino acid sequence set forth in SEQ ID NO:6 was evaluated by BLASTP, yielding a pLog value of 61.22 (E value of 6e-62) versus the *Pavlova* sp. CCMP459 C20-PUFA Elo (SEQ ID NO:2). The amino acid sequence set forth in SEQ ID NO:6 is 45.1% identical to the *Pavlova* sp. CCMP459 C20-PUFA Elo sequence (SEQ ID NO:2) using the Jotun Hein method. Sequence percent identity calculations performed by the Jotun Hein method (Hein, J. J., *Meth. Enz.* 183:626-645 (1990)) were done using the MegAlign™ v6.1 program of the LASERGENE bioinformatics computing suite (DNASTAR Inc., Madison, Wis.) with the default parameters for pairwise alignment (KTUPLE=2). The amino acid sequence set forth in SEQ ID NO:6 is 40.4% identical to the *Pavlova* sp. CCMP459 C20-PUFA Elo sequence (SEQ ID NO:2) using the Clustal V method. Sequence percent identity calculations performed by the Clustal V method (Higgins, D. G. and Sharp, P. M., *Comput. Appl. Biosci.* 5:151-153 (1989); Higgins et al., *Comput. Appl. Biosci.* 8:189-191 (1992)) were done using the MegAlign™ v6.1 program of the LASERGENE bioinformatics computing suite (supra) with the default parameters for pairwise alignment (KTUPLE=1, GAP PENALTY=3, WINDOW=5 and DIAGONALS SAVED=5 and GAP LENGTH PENALTY=10). BLAST scores and probabilities indicate that the instant nucleic acid fragment (SEQ ID NO:5) encodes an entire *Euglena gracilis* C20-PUFA Elo gene, hereby named EgC20elo1.

FIG. 25 summarizes BLASTP and percent identity values for EgC20elo1 (Example 3), EgDHAsyn1 (Example 4, infra), and EgDHAsyn2 (Example 5, infra).

Example 4

Identification of DHA Synthase 1 (EgDHAsyn1) from *Euglena gracilis* cDNA Library eeg1c cDNA clones encoding additional C20-PUFA Elo homologs were identified by conducting BLAST searches for similarity to sequences contained in the BLAST "nr" database as described in Example 3.

The BLASTX search using the nucleotide sequences from clone eeg1c.pk016.e6.f (also called pKR1049) revealed similarity of the protein encoded by the cDNA to the C20-PUFA Elo from *Pavlova* sp. CCMP459 (SEQ ID NO:2) (NCBI Accession No. AAV33630 (GI 54307108), locus AAV33630, CDS AY630573; Pereira et al., *Biochem. J.* 384:357-366 (2004)). The sequence of a portion of the cDNA insert from clone eeg1c.pk016.e6.f is shown in SEQ ID NO:9 (5' end of cDNA insert). Subsequently, the full insert sequence (eeg1c.pk016.e6.f:fis) was obtained as described in Example 3 and is shown in SEQ ID NO:10. The coding sequence is shown in SEQ ID NO:11; the corresponding deduced amino acid sequence is shown in SEQ ID NO:12.

The amino acid sequence set forth in SEQ ID NO:12 was evaluated by BLASTP as described in Example 3. Interestingly, SEQ ID NO:12 was found to be similar to both C20-PUFA Elo and delta-4 fatty acid desaturase. The N-terminus of SEQ ID NO:12 (from approximately amino acids 16-268) yields a μ Log value of 60.30 (E value of 5e-61; 124/258 identical amino acids; 48% identity) versus the *Pavlova* sp. CCMP459° C.20-PUFA Elo (SEQ ID NO:2). The C-terminus of SEQ ID NO:12 (from approximately amino acids 253-793) yields an E value of 0.0 (535/541 identical amino acids; 98% identity), versus the delta-4 fatty acid desaturase from *Euglena gracilis* (SEQ ID NO:13) (NCBI Accession No. AAQ19605 (GI 33466346), locus AAQ19605, CDS AY278558; Meyer et al., *Biochemistry* 42(32):9779-9788 (2003)). BLAST scores and probabilities indicate that the instant nucleic acid fragment (SEQ ID NO:11) encodes an entire *Euglena gracilis* C20-PUFA Elo/delta-4 fatty acid desaturase fusion gene, hereby named *Euglena gracilis* DHA synthase 1 (EgDHAsyn1).

The amino acid sequence of EgDHAsyn1 (SEQ ID NO:12) is 47.8% identical to the C20-PUFA Elo from *Pavlova* sp. CCMP459 (SEQ ID NO:2) and 98.9% identical to the delta-4 fatty acid desaturase from *Euglena gracilis* (SEQ ID NO:13), using the Jotun Hein method as described in Example 3. The amino acid sequence of EgDHAsyn1 (SEQ ID NO:12) is 41.2% identical to the C20-PUFA Elo from *Pavlova* sp. CCMP459 (SEQ ID NO:2) and 98.9% identical to the delta-4 fatty acid desaturase from *Euglena gracilis* (SEQ ID NO:13), using the Clustal V method as described in Example 3.

FIG. 27 summarizes BLASTP and percent identity values for EgDHAsyn1 (Example 4), EgC20elo1 (Example 3, supra) and EgDHAsyn2 (Example 5, infra).

Example 5

Identification of DHA synthase 2 (EqDHAsvn2) from *Euglena gracilis* cDNA Library eeg1c Approximately 17,000 clones of the *Euglena gracilis* cDNA library eeg1c were plated onto three large square (24 cm×24 cm) petri plates (Corning, Corning, N.Y.) each containing LB+50 μg/mL kanamycin agar media. Cells were grown overnight at 37° C., and plates were then cooled to room temperature.

Colony Lifts:

Biodyne B 0.45 μm membrane (Cat. No. 60207, Pall Corporation, Pensacola, Fla.) was trimmed to approximately 22 cm×22 cm, and the membrane was carefully laid on top of the agar to avoid air bubbles. After incubation for 2 min at room temperature, the membrane was marked for orientation, lifted off with tweezers, and placed colony-side up on filter paper soaked with 0.5 M sodium hydroxide and 1.5 M sodium chloride. After denaturation for 4 min, the sodium hydroxide was neutralized by placing the membrane on filter paper soaked with 0.5 M Tris-HCL (pH 7.5) and 1.5 M sodium chloride for 4 min. This step was repeated, and the membrane was rinsed briefly in 2×SSC buffer (20×SSC is 3M sodium chloride, 0.3 M sodium citrate; pH 7.0) and air dried on filter paper.

Hybridization:

Membranes were pre-hybridized at 65° C. in 200 mL hybridization solution for 2 hr. Hybridization solution contained 6×SSPE (20×SSPE is 3 M sodium chloride, 0.2 M sodium phosphate, 20 mM EDTA; pH 7.4), 5×Denhardt's reagent (100×Denhardt's reagent is 2% (w/v) Ficoll, 2% (w/v) polyvinylpyrrolidone, 2% (w/v) acetylated bovine serum albumin), 0.5% sodium dodecyl sulfate (SDS), 100 μg/mL sheared salmon sperm DNA, and 5% dextran sulfate.

A DNA probe was made using an agarose gel purified NcoI/NotI DNA fragment, containing EgDHAsyn1*, from pY141 (described in Example 10 herein) labeled with $P^{32}$ dCTP using the RadPrime DNA Labeling System (Cat. No. 18428-011, Invitrogen, Carlsbad, Calif.), following the manufacturer's instructions. Unincorporated $P^{32}$ dCTP was separated using a NICK column (Cat. No. 17-0855-02, Amersham Biosciences, Piscataway, N.J.), following the manufacturer's instructions. The probe was denatured for 5 min at 100° C. and placed on ice for 3 min; then, half was added to the hybridization solution.

The membrane was hybridized with the probe overnight at 65° C. with gentle shaking and then washed the following day twice with 2×SSC containing 0.5% SDS (5 min each) and twice with 0.2×SSC containing 0.1% SDS (15 min each). After washing, hyperfilm (Cat. No. RPN30K, Amersham Biosciences) was exposed to the membrane overnight at −80° C.

Based on alignment of plates with the exposed hyperfilm, positive colonies were picked using the blunt end of a Pasteur pipette into 1 mL of water and then vortexed. Several dilutions were made and plated onto small round Petri dishes (82 mm) containing LB media plus 50 µg/mL kanamycin to obtain around 100 well isolated colonies on a single plate. Lifts were done as described above except NytranN membrane circles (Cat, No. 10416116, Schleicher & Schuell, Keene, N.H.) were used, and hybridization was carried out in 100 mL using the remaining radiolabeled probe. In this way, one positive clone was identified (designated eeg1c-1). The plasmid from eeg1c-1 may also be referred to as pLF116.

The individual positive clone was grown at 37° C. in LB+50 µg/mL kanamycin liquid media, and plasmid was purified using the QIAprep® Spin Miniprep Kit (Qiagen Inc., Valencia, Calif.) following the manufacturer's protocol. The plasmid insert was sequenced as described in Example 2, with the ABI BigDye version 3 Prism sequencing kit using vector-primed M13F Universal primer (SEQ ID NO:1), vector-primed M13rev primer (SEQ ID NO:14), and the poly(A) tail-primed WobbleT oligonucleotides. Briefly, the WobbleT primer is an equimolar mix of 21 mer poly(T)A, poly(T)C, and poly(T)G, used to sequence the 3' end of cDNA clones. Based on initial sequence data, additional internal fragment sequence was obtained in a similar way using oligonucleotides oEUGel4-1 (SEQ ID NO:15), EgEloD4Mut-5 (SEQ ID NO:16), oEUGel4-2 (SEQ ID NO:17), EgDHAsyn5' (SEQ ID NO:18), and EgDHAsyn3' (SEQ ID NO:19). In this way, the full insert sequence of eeg1c-1 was obtained and is shown in SEQ ID NO:20. The coding sequence is shown as SEQ ID NO:21, while the corresponding deduced amino acid sequence is shown as SEQ ID NO:22.

The amino acid sequence set forth in SEQ ID NO:22 was evaluated by BLASTP as described in Example 3. As was the case for EgDHAsyn1, SEQ ID NO:22 was also found to be similar to both C20-PUFA Elo and delta-4 fatty acid desaturase. The N-terminus of SEQ ID NO:22 (from approximately amino acids 41-268) yields a µ Log value of 61.0 (E value of 1e-61; 118/231 identical amino acids; 51% identity) versus the *Pavlova* sp. CCMP459 C20-PUFA Elo (SEQ ID NO:2). The C-terminus of SEQ ID NO:22 (from approximately amino acids 253-793) yields an E value of 0.0 (541/541 identical amino acids; 100% identity), versus the amino acid sequence of delta-4 fatty acid desaturase from *Euglena gracilis* (SEQ ID NO:13). BLAST scores and probabilities indicate that the instant nucleic acid fragment (SEQ ID NO:21) encodes an entire *Euglena gracilis* C20-PUFA Elo/delta-4 fatty acid desaturase fusion gene, hereby named *Euglena gracilis* DHA synthase 2 (EgDHAsyn2).

The amino acid sequence of EgDHAsyn2 (SEQ ID NO:22) is 48.2% identical to the C20-PUFA Elo from *Pavlova* sp. CCMP459 (SEQ ID NO:2) and 100% identical to the delta-4 fatty acid desaturase from *Euglena gracilis* (SEQ ID NO:13), using the Jotun Hein method as described in Example 3. The amino acid sequence of EgDHAsyn2 (SEQ ID NO:22) is 41.2% identical to the C20-PUFA Elo from *Pavlova* sp. CCMP459 (SEQ ID NO:2) and 100% identical to the delta-4 fatty acid desaturase from *Euglena gracilis* (SEQ ID NO:13), using the Clustal V method as described in Example 3.

FIG. 25 summarizes BLASTP and percent identity values for EgDHAsyn2 (Example 5), EgC20elo1 (Example 3, supra) and EgDHAsyn1 (Example 4, supra).

Example 6

Primary Structure Analysis of EqC20elo1. EqDHAsvn1 and EqDHAsyn2

Given the 100% amino acid identity between the C-terminus of EgDHAsyn2 (SEQ ID NO:22) and the *Euglena gracilis* delta-4 desaturase (SEQ ID NO:13), a nucleotide sequence alignment was carried out between the coding sequence of EgDHAsyn2 (SEQ ID NO:21), the cDNA sequence of the *Euglena gracilis* delta-4 desaturase (SEQ ID NO:23) (NCBI Accession No. AY278558 (GI 33466345), locus AY278558, Meyer et al., *Biochemistry* 42(32):9779-9788 (2003)), and the coding sequence of the *Euglena gracilis* delta-4 desaturase (SEQ ID NO:24) (Meyer et al., supra). Sequence alignment was performed by the Clustal W method (using the MegAlign™ v6.1 program of the LASERGENE bioinformatics computing suite (DNASTAR Inc.) with the default parameters for multiple alignment (GAP PENALTY=10, GAP LENGTH PENALTY=0.2, Delay Divergen Seqs (%)=30, DNA Transition Weight=0.5, Protein Weight Matrix=Gonnet Series, DNA Weight Matrix=IUB). The alignment is shown in FIG. 2. The *Euglena gracilis* delta-4 desaturase coding sequence is named EgD4_CDS (SEQ ID NO:24); the *Euglena gracilis* delta-4 desaturase cDNA sequence is named EgD4_cDNA (SEQ ID NO:23); and the *Euglena gracilis* DHA synthase 2 coding sequence is named EgDHAsyn2_CDS (SEQ ID NO:21).

The 5' end (where the sequences are divergent) and the 3' end (where the sequences are identical) of the alignment are truncated in order to fit the alignment on one page. FIG. 2 illustrates that the sequences are highly divergent from the start of the *Euglena gracilis* delta-4 desaturase cDNA to 83 bp upstream of the coding sequence (CDS) start site. It is clear from the alignment that the nucleotide sequences for EgD4_cDNA and EgDHAsyn2_CDS are identical from 83 bp upstream of the CDS start site of the *Euglena gracilis* delta-4 desaturase cDNA sequence (SEQ ID NO:23), which is equivalent to nucleotide 674 of the EgDHAsyn2_CDS (SEQ ID NO:21), through to the end of the sequences. At the exact point of divergence, a NotI site can be found in the *Euglena gracilis* cDNA sequence (nucleotides 656-663 of SEQ ID NO:23), and since NotI linkers were used in the original cloning of the *Euglena gracilis* delta-4 desaturase cDNA (see Meyer et al., supra), it is likely that what was cloned was an incomplete, not full-length, transcript for EgDHAsyn2.

Figure 3A:
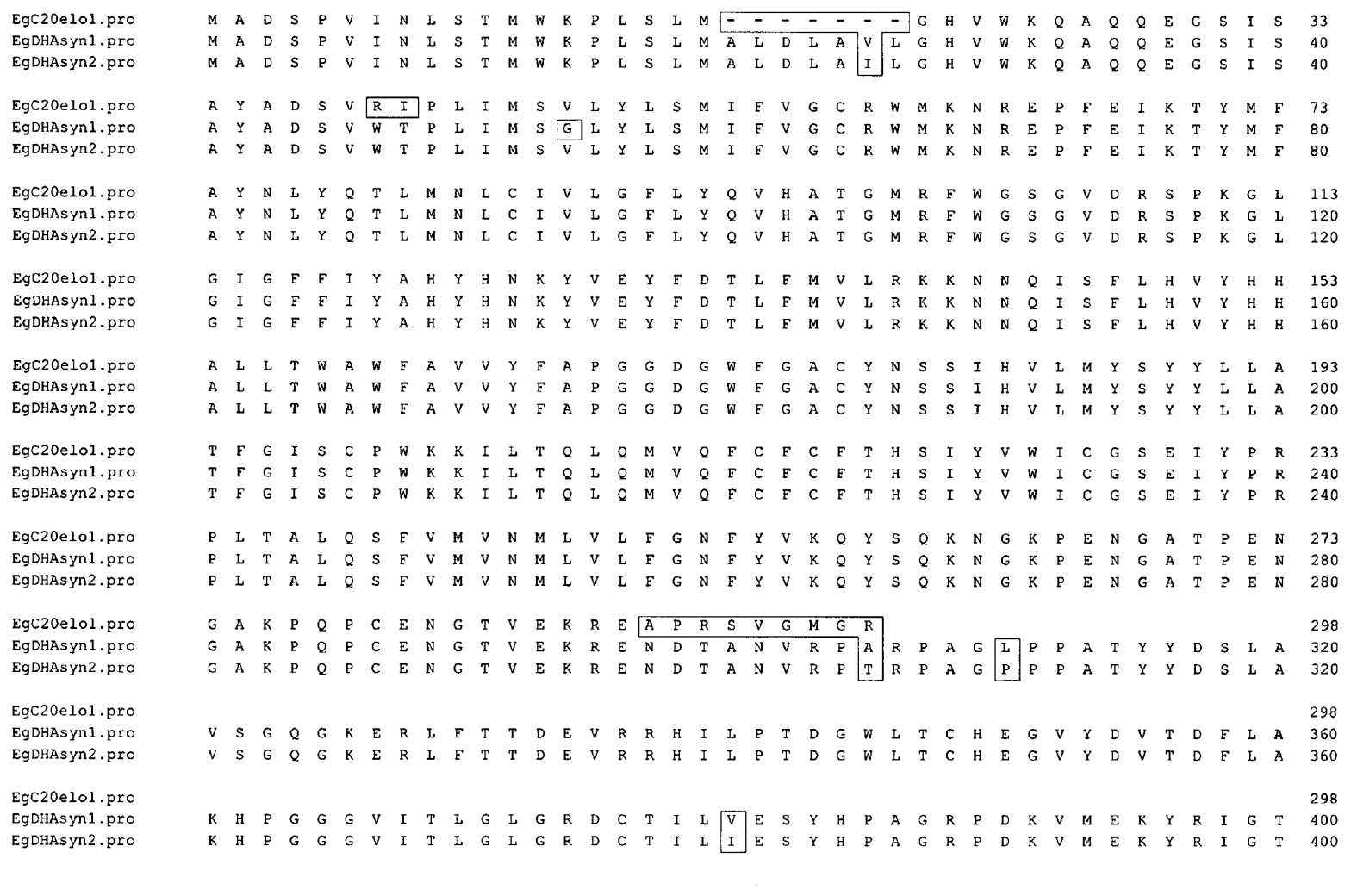
Figure 3B:
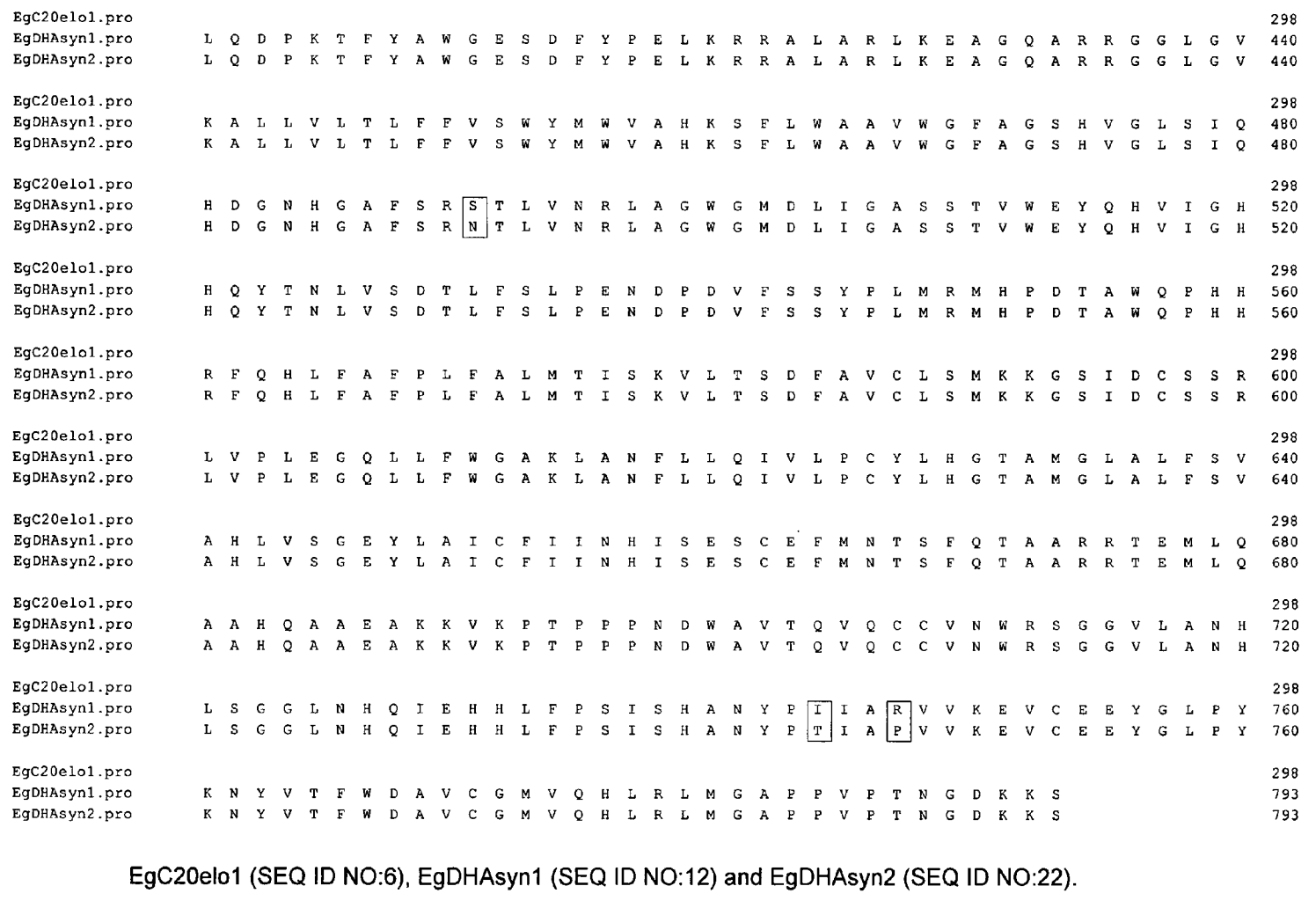

The amino acid sequence EgDHAsyn1 (SEQ ID NO:12) was compared to EgDHAsyn2 (SEQ ID NO:22) and EgC20elo1 (SEQ ID NO:6) using the Clustal W method as described above, and the alignment is shown in FIGS. 3A and 3B. Compared to EgDHAsyn1 and EgDHAsyn2, EgC20elo1 has a deletion of 7 amino acids (i.e., A L D L A [V/I] L) and 2 other amino acid substitutions (i.e., W47R, T481; based on numbering for EgDHAsyn1) at the N-terminus. After amino acid 289 of EgC20elo1, the sequences are very different when compared to the DHA synthases. EgDHAsyn1 and EgDHAsyn2 have an additional 498 amino acids at their C-terminal ends with homology to delta-4 fatty acid desaturases, while EgC20elo1 ends after only 9 additional amino acids. The amino acid sequences of EgDHAsyn1 (SEQ ID NO:12) and EgDHAsyn2 (SEQ ID NO:22) have 8 amino acid differences between the 2 sequences (i.e., V251, G54V, A305T, L310P, V3801, S491 N, I744T, R747P; based on numbering for EgDHAsyn1). The last four differences occur in the delta-4 desaturase domain.

Figure 4A:
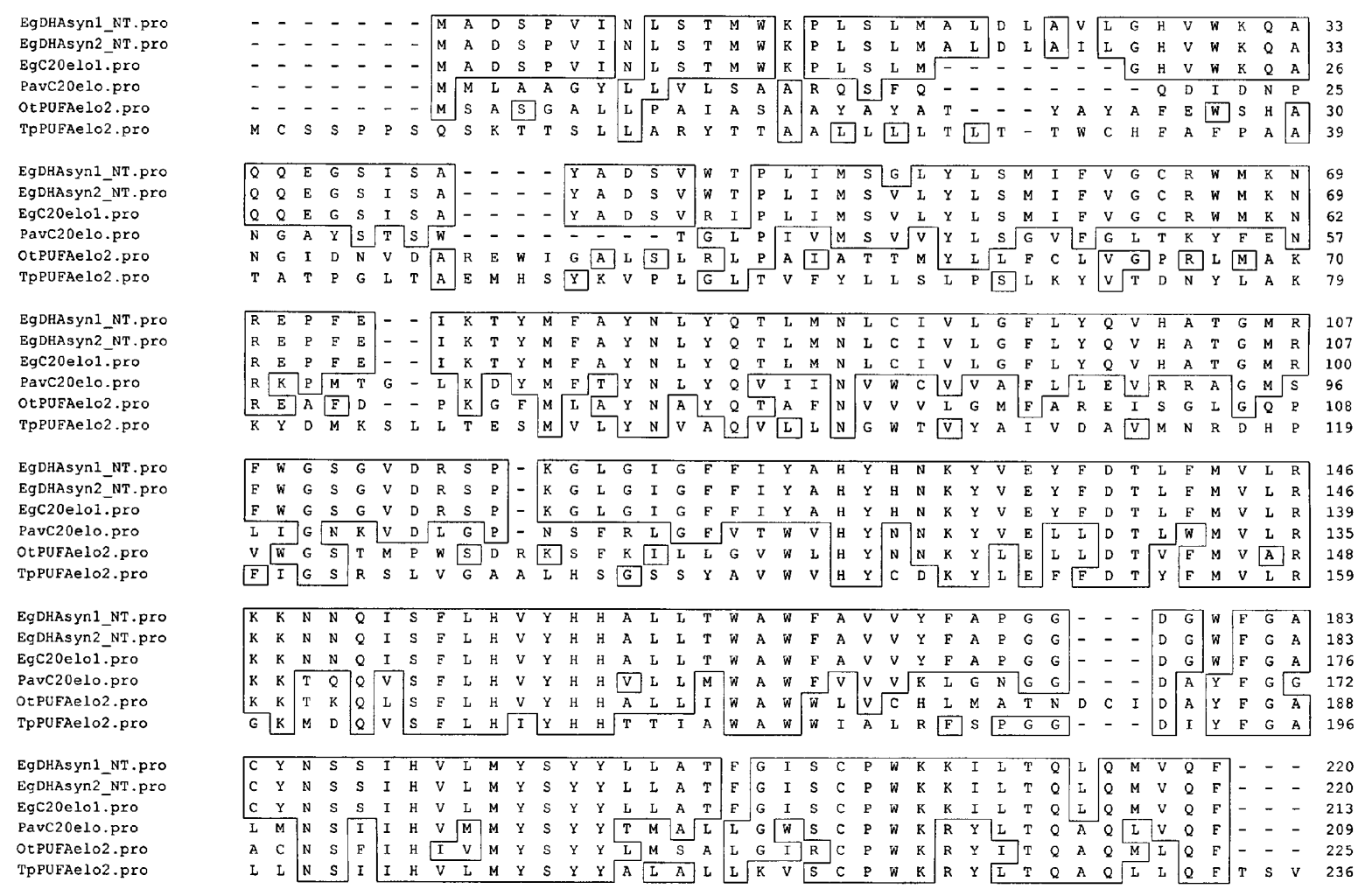

FIGS. 4A and 4B show the Clustal W alignment of the N-terminus of EgDHAsyn1 (SEQ ID NO:12) and the N-terminus of EgDHAsyn2 (SEQ ID NO:22) with EgC20elo1 (SEQ ID NO:6), *Pavlova* sp. CCMP459 C20-PUFA Elo (SEQ ID NO:2), *Ostreococcus tauri* PUFA elongase 2 (SEQ ID NO:25) (NCBI Accession No. AAV67798 (GI 55852396), locus AAV67798, CDS AY591336; Meyer et al., *J. Lipid Res.* 45(10):1899-1909 (2004)), and *Thalassiosira pseudonana* PUFA elongase 2 (SEQ ID NO:26) (NCBI Accession No. AAV67800 (GI 55852441), locus AAV67800, CDS AY591338; Meyer et al., *J. Lipid Res.*, supra). In FIGS. 4A and 4B, the *Pavlova*, *Ostreococcus*, and *Thalassiosira* proteins are labeled as PavC20elo, OtPUFAelo2, and TpPUFAelo2, respectively.

FIGS. 5A, 5B, 5C, and 5D show the Clustal W alignment of the C-terminus of EgDHAsyn1 (EgDHAsyn1_CT; amino acids 253-793 of SEQ ID NO:12; the N-terminus of EgDHAsyn1 is not shown and is indicated by " . . . ") and the C-terminus of EgDHAsyn2 (EgDHAsyn2_CT; amino acids 253-793 of SEQ ID NO:22, the N-terminus of EgDHAsyn2 is not shown and is indicated by " . . . ") with *Euglena gracilis* delta-4 fatty acid desaturase (SEQ ID NO:13), *Thraustochytrium aureum* delta-4 desaturase (SEQ ID NO:27) (NCBI Accession No. AAN75707(GI 25956288), locus MN75707, CDS AF391543), *Schizochytrium aggregatum* delta-4 desaturase (SEQ ID NO:28) (PCT Publication No. WO 2002/090493), *Thalassiosira pseudonana* delta-4 desaturase (SEQ ID NO:29) (NCBI Accession No. AAX14506 (GI 60173017), locus AAX14506, CDS AY817156; Tonon et al., *FEBS J.* 272 (13):3401-3412 (2005)), and *Isochrysis galbana* delta-4 desaturase (SEQ ID NO:30) (NCBI Accession No. AAV33631 (GI 54307110), locus AAV33631, CDS AY630574; Pereira et al., *Biochem. J.* 384(2),:357-366 (2004) and PCT Publication No. WO 2002/090493). In FIGS. 5A, 5B, 5C, and 5D, the *Euglena, Thraustochytrium, Thalassiosira*, and *Isochrysis* proteins are labeled as EgD4, TaD4, TpD4, and IgD4, respectively.

FIG. 6 shows an alignment of interior fragments of EgDHAsyn1 (labeled as "EgDHAsyn1_NCT.pro"; amino acids 253-365 of SEQ ID NO:12) and EgDHAsyn2 (labeled as "EgDHAsyn2_NCT.pro"; amino acids 253-365 of SEQ ID NO:22), spanning both the C20 elongase region and the delta-4 desaturase domain (based on homology), with the C-termini of C20 elongases (EgC20elo1_CT.pro, amino acids 246-298 of SEQ ID NO:6; PavC20elo_CT.pro, amino acids 240-277 of SEQ ID NO:2; OtPUFAelo2_CT.pro, amino acids 256-300 of SEQ ID NO:25; TpPUFAelo2_CT.pro, amino acids 279-358 of SEQ ID NO:26) and the N-termini of delta-4 desaturases (EgD4_NT.pro, amino acids 1-116 of SEQ ID NO:13; TaD4_NT.pro, amino acids 1-47 of SEQ ID NO:27; SaD4_NT.pro, amino acids 1-47 of SEQ ID NO:28; TpD4_NT.pro, amino acids 1-82 of SEQ ID NO:29; IgD4_NT.pro, amino acids 1-43 of SEQ ID NO:30) is shown. A conserved motif at the C-terminus of all the C20 elongase domains (i.e., VLFXXFYXXXY (SEQ ID NO:180)) is also present at the N-terminus of EgD4 and further supports EgD4 being an incomplete DHA synthase.

At the C-terminus of the C20 elongase domain for each of EgDHAsyn1, EgDHAsyn2, and EgC20elo1, there is a repeated sequence containing an NG motif (i.e., KNGK (SEQ ID NO:186), PENGA (SEQ ID NO:187), PENGA (SEQ ID NO:187), and PCENGTV (SEQ ID NO:191); called NG repeats and indicated in FIG. 6 with lines under the sequence). Although the pattern occurs with a high probability of occurrence, a scan of the NG repeated region using Prosite shows the last NG motif (i.e., NGTV) in this region as a potential N-glycosylation site. After the NG repeat region, both EgDHAsyn1 and EgDHAsyn2 contain a proline-rich region (labeled "Proline-rich linker" in FIG. 6), which may act as a linker between the C20 elongase and delta-4 desaturase domains. The linker may play a role in keeping the C20 elongase and delta-4 desaturase domains in the proper structural orientation to allow efficient conversion of EPA to DHA. Although the proline-rich linker is shown in FIG. 6 as extending from P304 to V321 (based on numbering for EgDHAsyn1), the NG repeat region is also somewhat proline-rich and may also play a role in this linker function.

The nucleotide and corresponding amino acid sequences for the proline-rich linker of EgDHAsyn1, as defined in FIG. 6, are set forth in SEQ ID NO:197 and SEQ ID NO:198, respectively. The nucleotide and corresponding amino acid sequences for the proline-rich linker of EgDHAsyn2, as defined in FIG. 6, are set forth in SEQ ID NO:199 and SEQ ID NO:200, respectively.

The nucleotide and corresponding amino acid sequences for the EgDHAsyn1 C20 elongase domain from EgDHAsyn1 are set forth in SEQ ID NO:201 and SEQ ID NO:202, respectively. The nucleotide and corresponding amino acid sequences for the EgDHAsyn2 C20 elongase domain are set forth in SEQ ID NO:203 and SEQ ID NO:204, respectively.

Example 7

Construction of pDMW263

Plasmid pY5-30 (which was previously described in U.S. Pat. No. 7,259,255 (the contents of which are hereby incorporated by reference)), is a shuttle plasmid that can replicate both in *E. coli* and *Yarrowia lipolytica*. Plasmid pY5-30 contains the following: a *Yarrowia* autonomous replication sequence (ARS18); a ColE1 plasmid origin of replication; an ampicillin-resistance gene (Amp$^R$), for selection in *E. coli*; a *Yarrowia* LEU2 gene, for selection in *Yarrowia*; and a chimeric TEF::GUS::XPR gene. Plasmid pDMW263 (SEQ ID NO:31) was created from pY5-30, by replacing the TEF promoter with the *Yarrowia lipolytica* FBAINm promoter (U.S. Pat. No. 7,202,356), using techniques well known to one skilled in the art. Briefly, the FBAIN promoter is located in the 5' upstream untranslated region in front of the 'ATG' translation initiation codon of the fructose-bisphosphate aldolase enzyme (E.C. 4.1.2.13), encoded by the fba1 gene. This promoter is necessary for expression and includes a portion of 5' coding region that has an intron. The modified promoter, FBAINm, has a 52 bp deletion between the ATG translation initiation codon and the intron of the FBAIN promoter (thereby including only 22 amino acids of the N-terminus) and a new translation consensus motif after the intron. Table 20 summarizes the components of pDMW263 (SEQ ID NO:31; also described in PCT Publication No. WO 2007/061845).

TABLE 20

Components of Plasmid pDMW263

| RE Sites and Nucleotides Within SEQ ID NO: 31 | Description of Fragment and Chimeric Gene Components |
|---|---|
| 4992-4296 | ARS18 sequence (GenBank Accession No. A17608) |
| SalI/SacII (8505-2014) | FBAINm::GUS::XPR, comprising:<br>FBAINm: FBAINm promoter (PCT Publication No. WO 2005/049805; U.S. Pat. No. 7,202,356)<br>GUS: *E. coli* gene encoding β-glucuronidase (Jefferson, R. A. Nature. 14: 342: 837-838 (1989)<br>XPR: ~100 bp of the 3' region of the *Yarrowia* Xpr gene (GenBank Accession No. M17741) |
| 6303-8505 | *Yarrowia* Leu2 gene (GenBank Accession No. AF260230) |

Example 8

Construction of *Yarrowia lipolytica* Expression Vector pY115 and Gateway® Destination Vectors pBY1 and pY159

Figure 7:
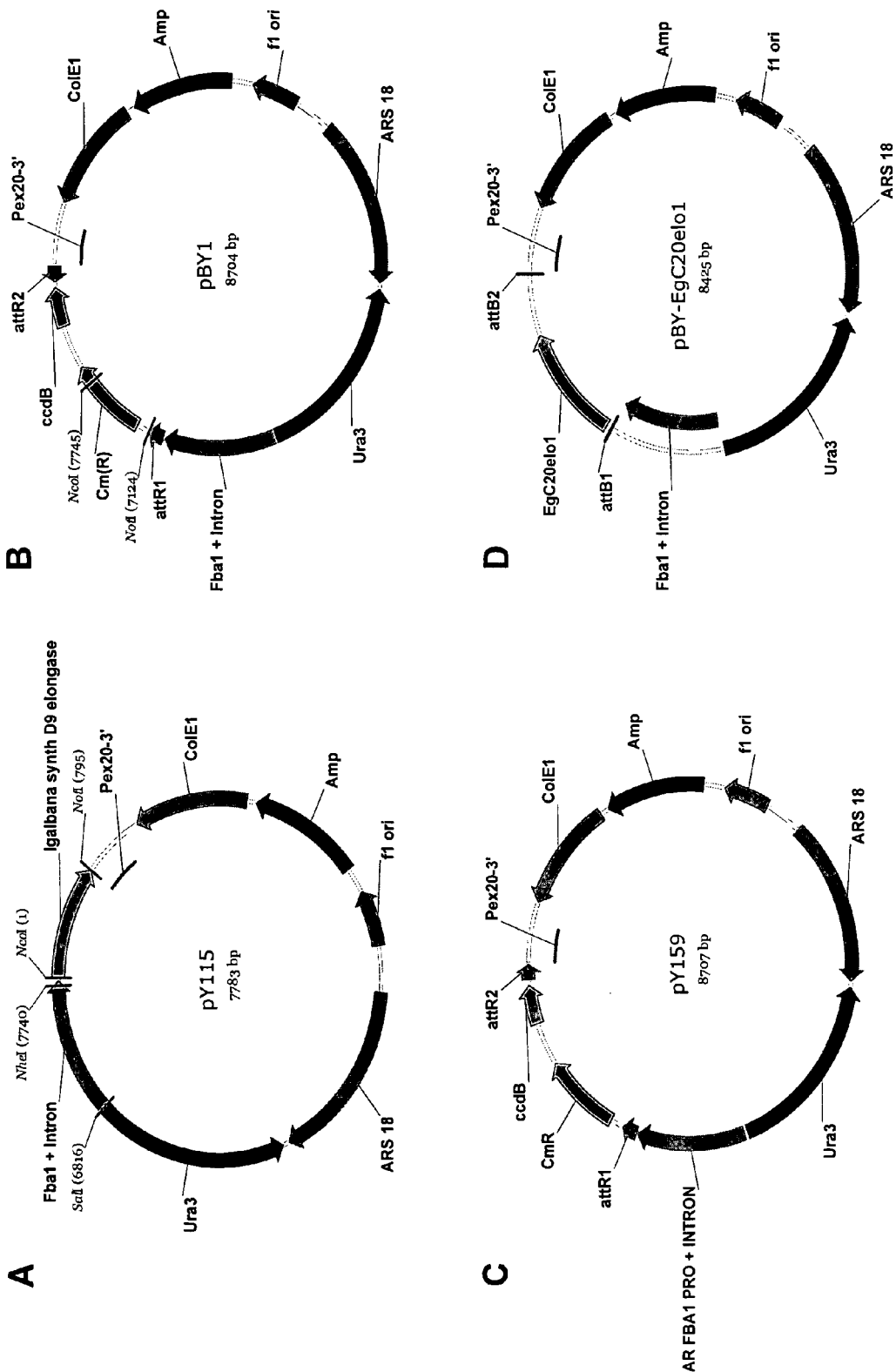

The NcoI/SalI DNA fragment from pDMW263 (SEQ ID NO:31) (see construction in Example 7), containing the *Yarrowia lipolytica* FBAINm promoter, was cloned into the NcoI/SalI DNA fragment of pDMW237 (SEQ ID NO:32), previously described in PCT Publication No. WO 2006/012325 (the contents of which are hereby incorporated by reference). pDMW237contains a synthetic delta-9 elongase gene derived from *Isochrysis galbana* and codon-optimized for expression in *Yarrowia lipolytica* (IgD9e). In this way, plasmid pY115 (SEQ ID NO:33; FIG. 7A) was produced. In FIG. 7A, the modified FBAINm promoter is called FBA1+Intron. The modified FBAINm promoter is referred to in other figures as either FBA1+ Intron or YAR FBA1 PRO+ Intron; these terms are used interchangeably with FBAINm.

Plasmid pY115 (SEQ ID NO:33) was digested with NcoI/NotI, and the resulting DNA ends were filled using Klenow. After filling to form blunt ends, the DNA fragments were treated with calf intestinal alkaline phosphatase and separated using agarose gel electrophoresis. The 6989 bp fragment containing the *Yarrowia lipolytica* FBAINm promoter was excised from the agarose gel and purified using the QIAquick® Gel Extraction Kit (Qiagen Inc., Valencia, Calif.), following the manufacturer's protocol. The purified 6989 bp fragment was ligated with cassette rfA using the Gateway Vector Conversion System (Cat. No. 11823-029, Invitrogen Corporation), following the manufacturer's protocol, to form *Yarrowia lipolytica* Gateway® destination vector pBY1 (SEQ ID NO:34; FIG. 7B).

In constructing pBY1, the filled NcoI site provides an ATG start for translation initiation. Thus, genes transferred to this expression vector are expressed as fusion proteins and must be in the correct frame after Gateway® cloning. Also, 5' untranslated sequence results in additional amino acids being added to the N-terminus of the resulting protein. For this reason, a second Gateway® destination vector was made which had the vector-derived ATG start codon removed, thus allowing for translational start from the gene inserted.

The FBAINm promoter was amplified from plasmid pY115 (SEQ ID NO:33), using PCR with oligonucleotide primers oYFBA1 (SEQ ID NO:35) and oYFBA1-6 (SEQ ID NO:36). Primer oYFBA1 (SEQ ID NO:35) was designed to introduce a BglII site at the 5' end of the promoter, and primer oYFBA1-6 (SEQ ID NO:36) was designed to introduce a NotI site at the 3' end of the promoter while removing the NcoI site and thus, the ATG start codon. The resulting PCR fragment was digested with BglII and NotI and cloned into the BglII/NotI fragment of pY115, containing the vector backbone, to form pY158 (SEQ ID NO:37).

Plasmid pY158 (SEQ ID NO:37) was digested with NotI, and the resulting DNA ends were filled. After filling to form blunt ends, the DNA fragments were treated with calf intestinal alkaline phosphatase and separated using agarose gel electrophoresis. The 6992 bp fragment containing the *Yarrowia lipolytica* FBAINm promoter was excised from the agarose gel and purified using the QIAquick® Gel Extraction Kit (Qiagen Inc., Valencia, Calif.), following the manufacturer's protocol. The purified 6992 bp fragment was ligated with cassette rfA using the Gateway Vector Conversion System (Cat. No. 11823-029, Invitrogen Corporation), following the manufacturer's protocol, to form *Yarrowia lipolytica* Gateway® destination vector pY159 (SEQ ID NO:38; FIG. 7C).

Example 9

Construction of *Yarrowia lipolytica* Expression Vectors pBY-EqC20elo1 (EgC20elo1). Y132 (EgDHAsyn1), pY161 (EgDHAsyn1) and pY164 (EgDHAsyn2)

Figure 8:
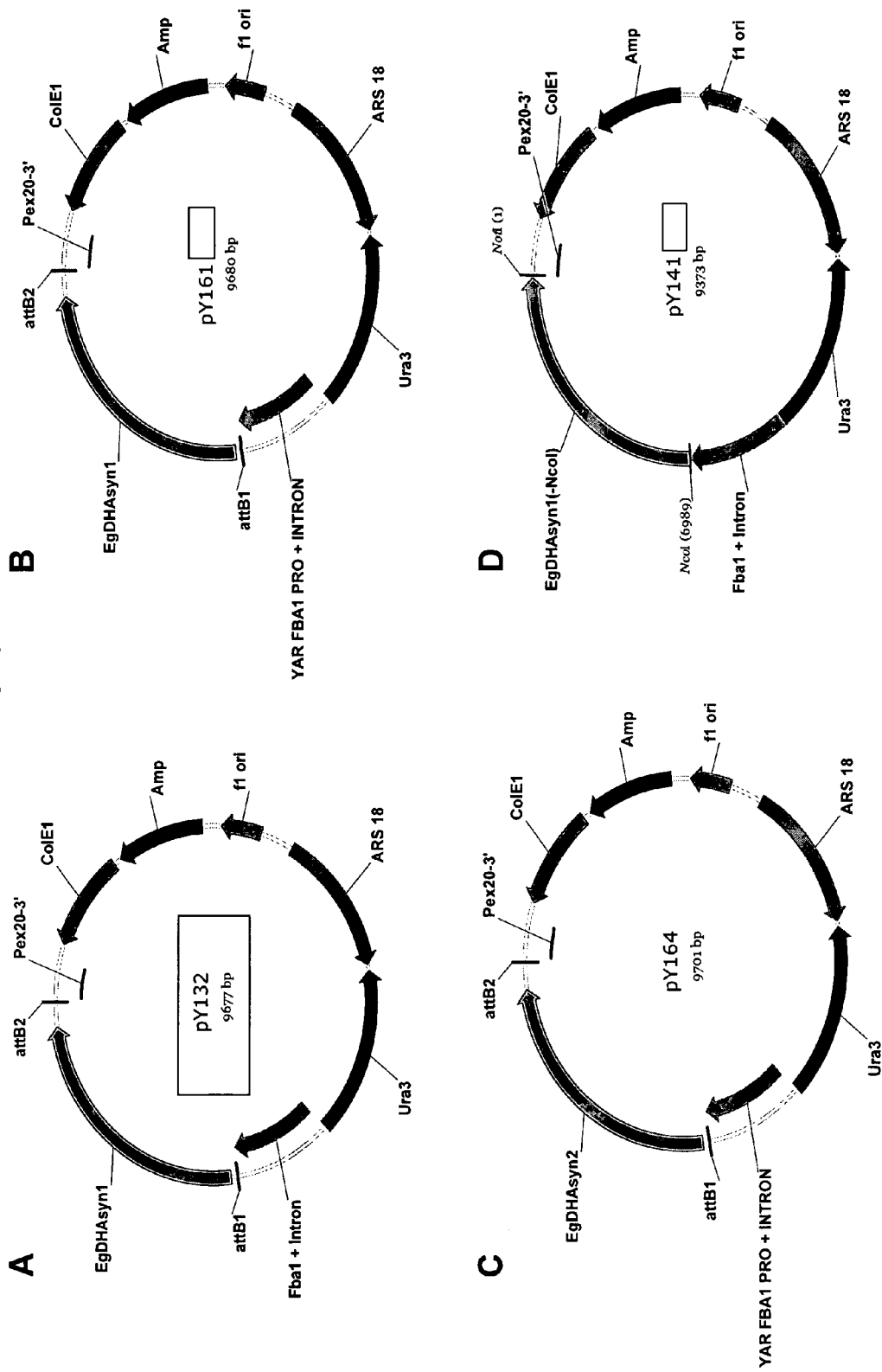

Plasmid was purified from clones eeg1c.pk005.p14.f (Example 3), eeg1c.pk016.e6.f (Example 4), and eeg1c-1 (Example 5) using the QIAprep® Spin Miniprep Kit (Qiagen Inc., Valencia, Calif.), following the manufacturer's protocol. Using the Gateway® LR Clonase™ II enzyme mix (Cat. No. 11791-020, Invitrogen Corporation) and following the manufacturer's protocol, the cDNA inserts from eeg1c.pk001.p14.f (comprising EgC20elo1) and eeg1c.pk016.e6.f (comprising EgDHAsyn1) were transferred to pBY1 (SEQ ID NO:34; FIG. 7B) to form pBY-EgC20elo1 (SEQ ID NO:39, FIG. 7D) and pY132 (SEQ ID NO:40; FIG. 8A), respectively. The cDNA insert from eeg1c-1 (comprising EgDHAsyn2) was not transferred to pBY1, because it would have resulted in the wrong translation frame being expressed.

Using the Gateway® LR Clonase™ II enzyme mix (Cat. No. 11791-020, Invitrogen Corporation) and following the manufacturer's protocol, the cDNA inserts from eeg1c.pk016.e6.f and eeg1c-1 were transferred to pY159 (SEQ ID NO:38; Example 8) to form pY161 (SEQ ID NO:41, FIG. 8B) and pY164 (SEQ ID NO:42; FIG. 8C), respectively.

Example 10

Construction of *Yarrowia lipolytica* Expression Vectors pY141 (EgDHAsvn1*) pY143 (EgDHAsvn1*C20EIoDom1) and pY149 (EgDHAsvn1*C20EloDom2Linker)

EgDHAsyn1 was amplified from clone eeg1c.pk001.e6.f with oligonucleotide primers EgEPAEloDom-5 (SEQ ID NO:43) and oEUG e14-3 (SEQ ID NO:44), using the Phusion™ High-Fidelity DNA Polymerase (Cat. No. F553S, Finnzymes Oy, Finland) following the manufacturer's protocol. The resulting DNA fragment was cloned into the pCR-Blunt® cloning vector using the Zero Blunt® PCR Cloning Kit (Invitrogen Corporation), following the manufacturer's protocol, to produce pKR1062 (SEQ ID NO:45).

An internal NcoI site at nucleotides 619-624 was removed from EgDHAsyn1 in pKR1062 using the Quickchange® Site Directed Mutagenesis kit (Cat. No. 200518, Stratagene, La Jolla, Calif.), with oligonucleotides EgEloD4Mut-5 (SEQ ID NO:46) and EgEloD4Mut-3 (SEQ ID NO:47), following the manufacturer's protocol. After extensive sequencing, a clone with the NcoI site removed (i.e., a ccatgg to ccttgg mutation) and no further nucleotide changes made was chosen for further study. This clone was designated pLF115-7 (SEQ ID NO:48). The nucleotide sequence for EgDHAsyn1 having the NcoI site removed (EgDHAsyn1*) is set forth in SEQ ID NO:205. The corresponding amino acid sequence is identical to SEQ ID NO:12.

Construction Of Plasmid pY141, Expressing EgDHAsyn1*:

The NcoI/NotI DNA fragment from pLF115-7 (SEQ ID NO:48), containing EgDHAsyn1 (SEQ ID NO:205; without the internal NcoI site; at nt 621 of the EgDHAsyn1 CDS; ccatgg to ccttgg), was cloned into the NcoI/NotI DNA fragment from pY115, containing the *Yarrowia lipolytica* FBAINm promoter, to produce pY141 (SEQ ID NO:49; FIG. 8D). Thus, plasmid pY141 contains the full length EgDHAsyn1*gene (labeled as "EgDHAsyn1 (-NcoI)" in FIG.), under control of the *Yarrowia lipolytica* FBAINm promoter (PCT Publication No. WO 2005/049805; U.S. Pat. No. 7,202,356; labeled as "Fba1+Intron" in FIG.), and the Pex20 terminator sequence from *Yarrowia* Pex20 gene (GenBank Accession No. AF054613).

Construction Of Plasmid pY143, Expressing EgDHAsyn1-C20EloDom1:

The nucleotide sequence for the EgDHAsyn1*C20 elongase domain (EgDHAsyn1C20EloDom1) in pY141 is set forth in SEQ ID NO:206 (identical to SEQ ID NO:201 but NcoI site removed). The corresponding amino acid sequence is identical to SEQ ID NO:202.

The EgDHAsyn1C20EloDom1 (SEQ ID NO:206) was amplified from pLF115-7 with oligonucleotide primers EgEPAEloDom-5 (SEQ ID NO:43) and EgDPAEloDom-3 (SEQ ID NO:50) using the Phusion™ High-Fidelity DNA Polymerase (Cat. No. F553S, Finnzymes Oy, Finland) following the manufacturer's protocol. The resulting DNA fragment was cloned into the pCR-Blunt® cloning vector using the Zero Blunt® PCR Cloning Kit (Invitrogen Corporation), following the manufacturer's protocol, to produce pHD16 (SEQ ID NO:51).

Figure 9:
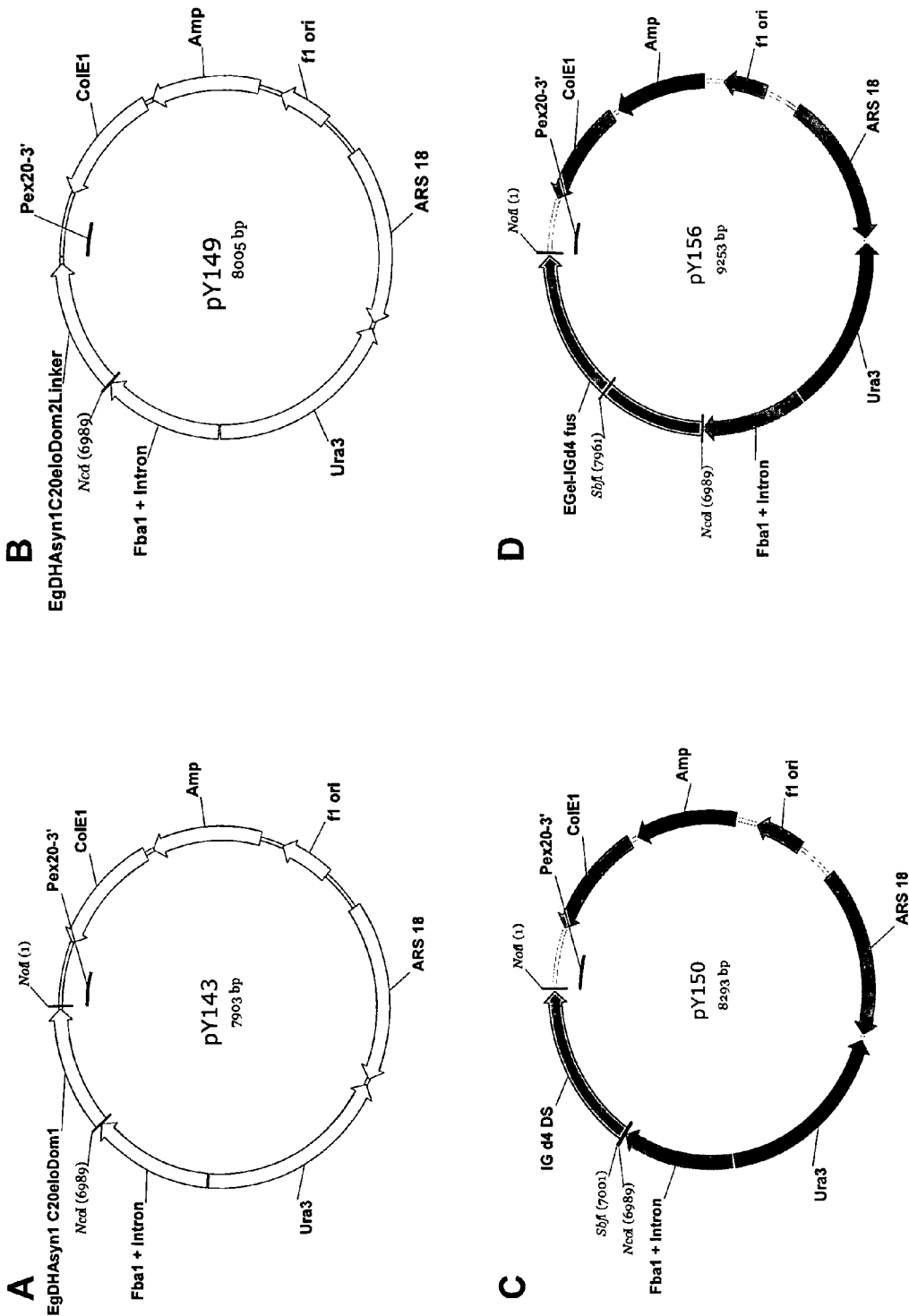

The NcoI/NotI DNA fragment from pHD16 (SEQ ID NO:51), containing the EgDHAsyn1 C20EloDom1 (without the internal NcoI site), was cloned into the NcoI/NotI DNA fragment from pY115, containing the *Yarrowia lipolytica* FBAINm promoter, to produce pY143 (SEQ ID NO:52; FIG. 9A). Plasmid pY143 contains the N-terminal domain of EgDHAsyn1*(EgDHAsyn1C20EloDom1) and does not include the proline-rich linker or delta-4 desaturase domain.

Construction Of Plasmid pY149, Expressing EqDHAsvn1-C20EloDom2Linker: The EgDHAsyn1*C20 elongase domain (SEQ ID NO:206) and proline-rich linker (SEQ ID NO:197), were amplified from pLF115-7 (SEQ ID NO:48) with oligonucleotide primers EgEPAEloDom-5 (SEQ ID NO:43) and oEUGsyn6-2 (SEQ ID NO:53) using the Phusion™ High-Fidelity DNA Polymerase (Cat. No. F553S, Finnzymes Oy, Finland) following the manufacturer's protocol. The resulting DNA fragment was cloned into the pCR-Blunt® cloning vector using the Zero Blunt® PCR Cloning Kit (Invitrogen Corporation), following the manufacturer's protocol, to produce pKR1071 (SEQ ID NO:54).

The NcoI/Ecl132II DNA fragment from pKR1071 (SEQ ID NO:54) was cloned into the NcoI/NotI DNA fragment from pY115 (where the NotI site had been filled in), containing the *Yarrowia lipolytica* FBAINm promoter, to produce pY149 (SEQ ID NO:55; FIG. 9B). Plasmid pY149 contains the EgDHAsyn1C20EloDom1/proline-rich linker fusion gene (i.e., EgDHAsyn1C20EloDom2Linker; SEQ ID NO:207), but does not contain the delta-4 desaturase domain. The amino acid sequence of EgDHAsyn1C20EloDom2Linker is set forth in SEQ ID NO:208. In addition to the amino acids from EgDHAsyn1*C20 elongase domain and proline-rich linker, an additional 4 amino acids (i.e., SCRT) were added after the linker region as a result of how the fragment was synthesized and cloned.

Example 11

Construction of *Yarrowia lipolytica* Expression Vectors for Generation of Novel C20 Elongase/Delta-4 Desaturase Fusion Proteins In order to synthesize novel C20 elongase/delta-4 desaturase fusion proteins, a unique SbfI site was added to the 3' end of the C20 elongase domain of EgDHAsyn1*after the proline-rich linker region (EgDHAsyn1 C20EloDom3Linker). EgDHAsyn1 C20EloDom3 was amplified from pLF115-7 (SEQ ID NO:48) with oligonucleotide primers EgEPAEloDom-5 (SEQ ID NO:43) and oEUGsyn6-3 (SEQ ID NO:56) using the Phusion™ High-Fidelity DNA Polymerase (Cat. No. F553S, Finnzymes Oy, Finland) following the manufacturer's protocol. The resulting DNA fragment was cloned into the pCR-Blunt® cloning vector using the Zero Blunt® PCR Cloning Kit (Invitrogen Corporation), following the manufacturer's protocol, to produce pKR1091 (SEQ ID NO:57).

The NcoI/Ecl13611 DNA fragment from pKR1091 (SEQ ID NO:57), containing EgDHAsyn1 C20EloDom3Linker, was cloned into the NcoI/NotI DNA fragment from pY115 (where the NotI was filled to form a blunt end), containing the *Yarrowia lipolytica* FBAINm promoter, to produce pY155 (SEQ ID NO:58).

In order to synthesize novel C20 elongase/delta-4 desaturase fusion proteins, a unique SbfI site was added to the 5' end of various delta-4 desaturases. In each case, the SbfI site is located after the ATG start site of each coding sequence and resulted in the addition and/or replacement of a few amino acids at the N-terminus of the delta-4 desaturase coded for by the genes.

Construction Of Plasmid pY156. Expressing EgDHAsvn1-C20EloDom3-IgD4*:

The *Isochrysis galbana* delta-4 desaturase (SEQ ID NO:209; IgD4) was amplified from pRIG6 (previously described in PCT Publication No. WO 2002/090493) with oligonucleotides oRIG6-1 (SEQ ID NO:59) and oRIG6-2 (SEQ ID NO:60) using the Phusion™ High-Fidelity DNA Polymerase (Cat. No. F553S) following the manufacturer's protocol. The resulting DNA fragment, which contains the IgD4 CDS and is identical to SEQ ID NO:209 except that an SbfI site was added at the 5' end after the start codon (IgD4*; SEQ ID NO:210), was cloned into the pCR-Blunt® cloning vector using the Zero Blunt® PCR Cloning Kit (Invitrogen Corporation), following the manufacturer's protocol, to produce pKR1067 (SEQ ID NO:61). The amino acid sequence for IgD4* from pKR1067 is set forth in SEQ ID NO:211 and is identical to that to IgD4 (SEQ ID NO:30) except that the first 4 amino acids (i.e., MCNA) have been changed to MALQ due to the addition of the SbfI site in the nucleotide sequence.

The NcoI/NotI DNA fragment from pKR1067 (SEQ ID NO:61), containing IgD4*, was cloned into the NcoI/NotI DNA fragment from pY115, containing the *Yarrowia lipolytica* FBAINm promoter, to produce pY150 (SEQ ID NO:62;

FIG. 9C). In FIG. 9C, IgD4* is labeled as "Ig d4 DS". In this way, IgD4* could be expressed alone in *Yarrowia*.

The XbaI/SbfI DNA fragment from pKR1091 (SEQ ID NO:57; supra), containing EgDHAsyn1C20EloDom3Linker, was cloned into the XbaI/SbfI DNA fragment from pKR1067 (SEQ ID NO:61), containing IgD4*, to produce pKR1097 (SEQ ID NO:63). Thus, an in-frame fusion was made between EgDHAsyn1C20EloDom3Linker and IgD4*, separated by the proline-rich linker region (called EgDHAsyn1C20EloDom3-IgD4; SEQ ID NO:212). The amino acid sequence for EgDHAsyn1 C20EloDom3-IgD4 is set forth in SEQ ID NO:213.

The NcoI/NotI DNA fragment from pKR1097 (SEQ ID NO:63), containing the EgDHAsyn1 C20EloDom3-IgD4, was cloned into the NcoI/NotI DNA fragment from pY115, containing the *Yarrowia lipolytica* FBAINm promoter, to produce pY156 (SEQ ID NO:64; FIG. 9D). In FIG. 9D, the EgDHAsyn1C20EloDom3-IgD4 is labeled as "EGel-IGd4".

Construction Of Plasmid pY152, Expressing EqDHAsyn1-D4Dom1*: A region of the C-terminus of EgDHAsyn1*(SEQ ID NO:205) containing the delta-4 desaturase domain (EgDHAsyn1 D4Dom1; SEQ ID NO:214; corresponding amino acid sequence for EgDHAsyn1 D4Dom1 is set forth in SEQ ID NO:215), starting just after the end of the proline-rich linker region, was amplified from pLF115-7 (as described in Example 10) with oligonucleotides oEGslne6-1 (SEQ ID NO:65) and oEUGel4-3 (SEQ ID NO:44) using the Phusion™ High-Fidelity DNA Polymerase (Cat. No. F553S) following the manufacturer's protocol. Oligonucleotide oEGslne6-1 (SEQ ID NO:65) introduced an ATG start codon at the 5' end of the PCR product followed by an SbfI site. The resulting DNA fragment was cloned into the pCR-Blunt® cloning vector using the Zero Blunt® PCR Cloning Kit (Invitrogen Corporation), following the manufacturer's protocol, to produce pKR1069 (SEQ ID NO:66). The new CDS and amino acid sequences containing EgDHAsyn1 D4Dom1 from pKR1069 (i.e., EgDHAsyn1D4Dom1*) are set forth in SEQ ID NO:216 and SEQ ID NO:217, respectively. The amino acid sequence for EgDHAsyn1 D4Dom1* (SEQ ID NO:217) is identical to that of EgDHAsyn1 D4Dom1 (SEQ ID NO:215), except that the first 2 amino acids (i.e., SG) have been changed to MAL due to the addition of the SbfI site in the nucleotide sequence.

Figure 10:
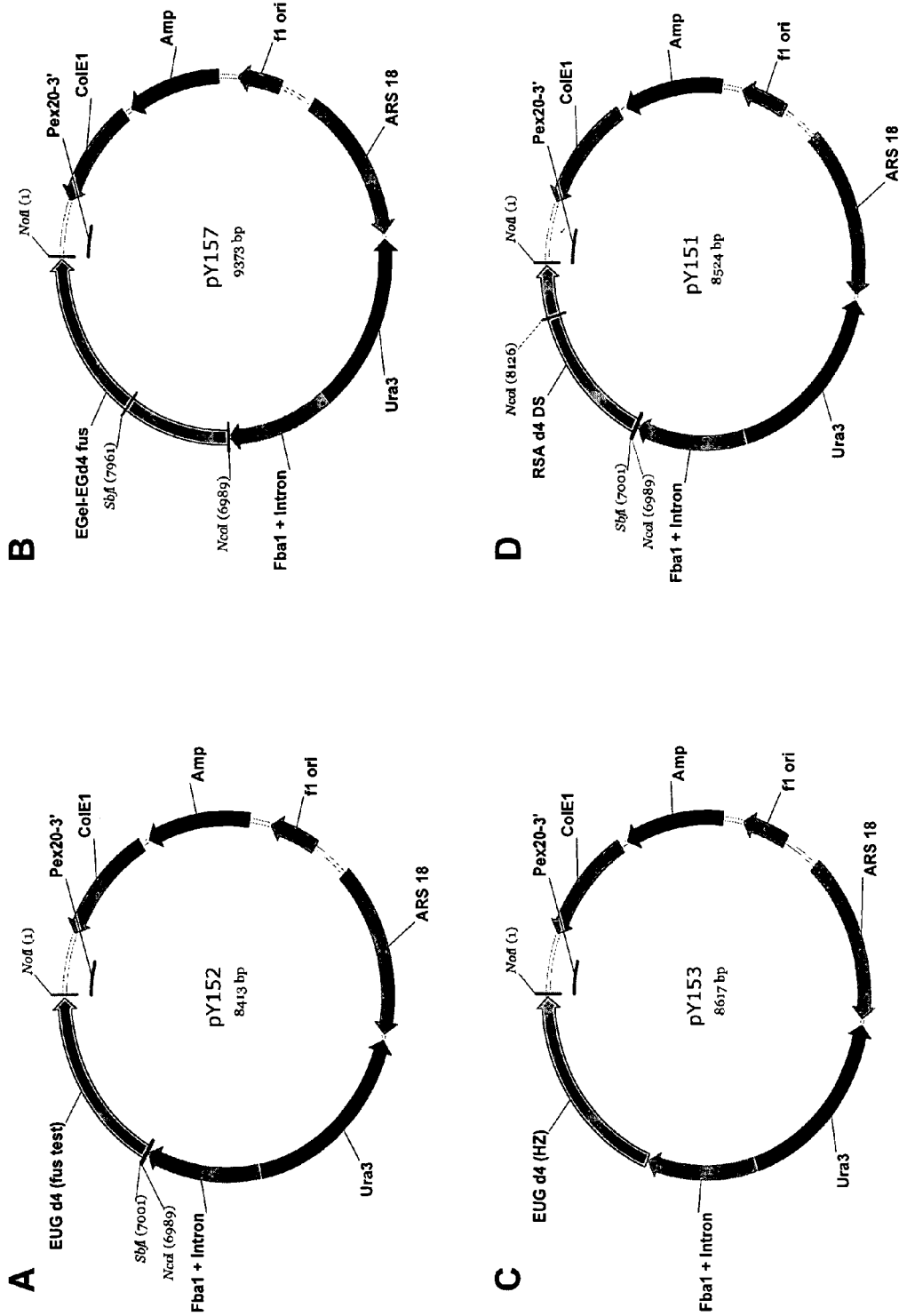

The NcoI/NotI DNA fragment from pKR1069 (SEQ ID NO:66), containing the EgDHAsyn1 D4Dom1*, was cloned into the NcoI/NotI DNA fragment from pY115, containing the *Yarrowia lipolytica* FBAINm promoter, to produce pY152 (SEQ ID NO:67; FIG. 10A). In FIG. 10A, the EgDHAsyn1D4Dom1* is labeled as "EUG d4 (fus test)". In this way, the EgDHAsyn1 D4Dom1* could be expressed alone in *Yarrowia*.

Construction Of Plasmid pY157, Expressing EgDHAsyn1-C20EloDom3-EqD4Dom1: The XbaI/SbfI DNA fragment from pKR1091 (SEQ ID NO:57), containing EgDHAsyn1C20EloDom3-Linker, was cloned into the XbaI/SbfI DNA fragment from pKR1069, containing the EgDHAsyn1 D4Dom1*, to produce pKR1099 (SEQ ID NO:68). In this way, an in-frame fusion was made between the EgDHAsyn1 C20EloDom and the EgDHAsyn1 D4Dom1*, separated by the proline-rich linker region (called EgDHAsyn1C20EloDom3-EgD4Dom1; SEQ ID NO:218). The amino acid sequence of EgDHAsyn1C20EloDom3-EgD4Dom1 (SEQ ID NO:219) is almost identical to EgDHAsyn1 except one amino acid (i.e., G323L based on numbering for EgDHAsyn1) was changed due to the SbfI cloning site and fusion junction.

The NcoI/NotI DNA fragment from pKR1099 (SEQ ID NO:68), containing the EgDHAsyn1 C20EloDom3-EgD4Dom1, was cloned into the NcoI/NotI DNA fragment from pY115, containing the *Yarrowia lipolytica* FBAINm promoter, to produce pY157 (SEQ ID NO:69; FIG. 10B). In FIG. 10B, the EgDHAsyn1C20EloDom3-EgD4Dom1 is labeled as "EGel-EGd4 fus".

Construction Of Plasmid pY153, Expressing EqDHAsyn1*D4Dom2: A region of the C-terminus of EgDHAsyn1 containing the delta-4 desaturase domain and some of the C20 elongase domain (EgDHAsyn1 D4Dom2; SEQ ID NO:220; corresponding amino acid sequence for EgDHAsyn1 D4Dom2 is set forth in SEQ ID NO:221), which corresponds to the amino acid sequence identified as EgD4 (SEQ ID NO:13; Meyer et al., Biochemistry 42(32):9779-9788 (2003)), was amplified from pLF115-7 (described in Example 10) with oligonucleotides oEUGel4-4 (SEQ ID NO:70) and oEUGel4-3 (SEQ ID NO:44) using the Phusion™ High-Fidelity DNA Polymerase (Cat. No. F553S) following the manufacturer's protocol. The resulting DNA fragment was cloned into the pCR-Blunt® cloning vector using the Zero Blunt® PCR Cloning Kit (Invitrogen Corporation), following the manufacturer's protocol, to produce pKR1073 (SEQ ID NO:71).

The PciI/NotI DNA fragment from pKR1073 (SEQ ID NO:71), containing the EgDHAsyn1 D4Dom2, was cloned into the NcoI/NotI DNA fragment from pY115, containing the *Yarrowia lipolytica* FBAINm promoter, to produce pY153 (SEQ ID NO:72; FIG. 10C). In FIG. 1C, the EgDHAsyn1 D4Dom2 is labeled as EUG d4 (HZ). In this way, the EgDHAsynD4Dom2 could be expressed alone in *Yarrowia*.

Construction Of Plasmid pY160, Expressing EgDHAsyn1-C20EloDom3-SaD4*: The *Schizochytrium aggregatum* delta-4 desaturase (SEQ ID NO:222; SaD4) was amplified from pRSA-1 (previously described in PCT Publication No. WO 2002/090493) with oligonucleotides oRSA1-1 (SEQ ID NO:73) and oRSA1-2 (SEQ ID NO:74) using the Phusion™ High-Fidelity DNA Polymerase (Cat. No. F553S) following the manufacturer's protocol. The resulting DNA fragment, which contains the SaD4 CDS and is identical to SEQ ID NO:222, except that an SbfI site was added at the 5' end after the start codon (SaD4*; SEQ ID NO:223), was cloned into the pCR-Blunt® cloning vector using the Zero Blunt® PCR Cloning Kit (Invitrogen Corporation), following the manufacturer's protocol, to produce pKR1068 (SEQ ID NO:75). The amino sequence for SaD4* from pKR1068 is set forth in SEQ ID NO:224 and is identical to that to SaD4 (SEQ ID NO:28) except that the first 3 amino acids (i.e., MTV) have been changed to MALQ due to the addition of the SbfI site in the nucleotide sequence.

The NcoI/NotI DNA fragment from pKR1068 (SEQ ID NO:75) (partial digest to avoid internal NcoI site), containing the SaD4*, was cloned into the NcoI/NotI DNA fragment from pY115, containing the *Yarrowia lipolytica* FBAINm promoter, to produce pY151 (SEQ ID NO:76; FIG. 10D). In FIG. 10D, the SaD4* is labeled as "RSA d4 DS". In this way, the SaD4* could be expressed alone in *Yarrowia*.

Figure 11:
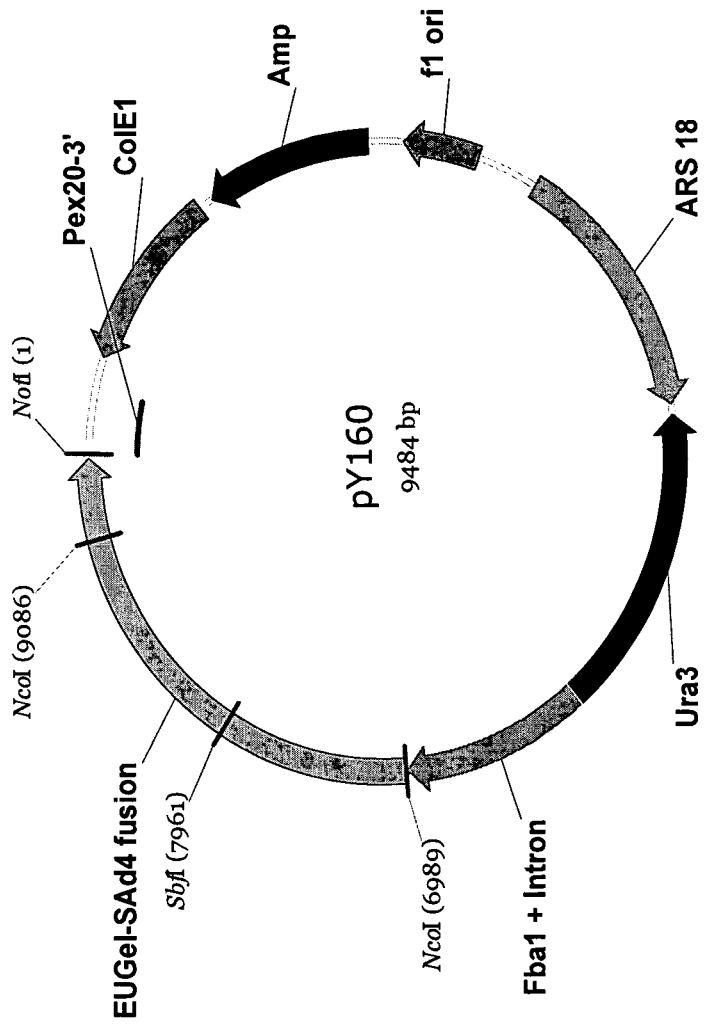
FIG. 11 is a map of pY160 (see also SEQ ID NO:77).

The SbfI/NotI DNA fragment from pKR1068 (SEQ ID NO:75), containing the SaD4*, was cloned into the SbfI/NotI DNA fragment from pY157 (SEQ ID NO:69), containing the EgDHAsyn1C20EloDom3Linker, to produce pY160 (SEQ ID NO:77; FIG. 11). In this way, an in-frame fusion was made between the EgDHAsyn1C20EloDom3 and the SaD4*, separated by the proline-rich linker region (i.e., EgDHAsyn1C20EloDom3-SaD4; SEQ ID NO:225). The amino acid sequence for EgDHAsyn1C20EloDom3-SaD4 is set forth in SEQ ID NO:226.

Example 12

Euglena anabaena Growth Conditions, Lipid Profile and mRNA Isolation

Figure 12:
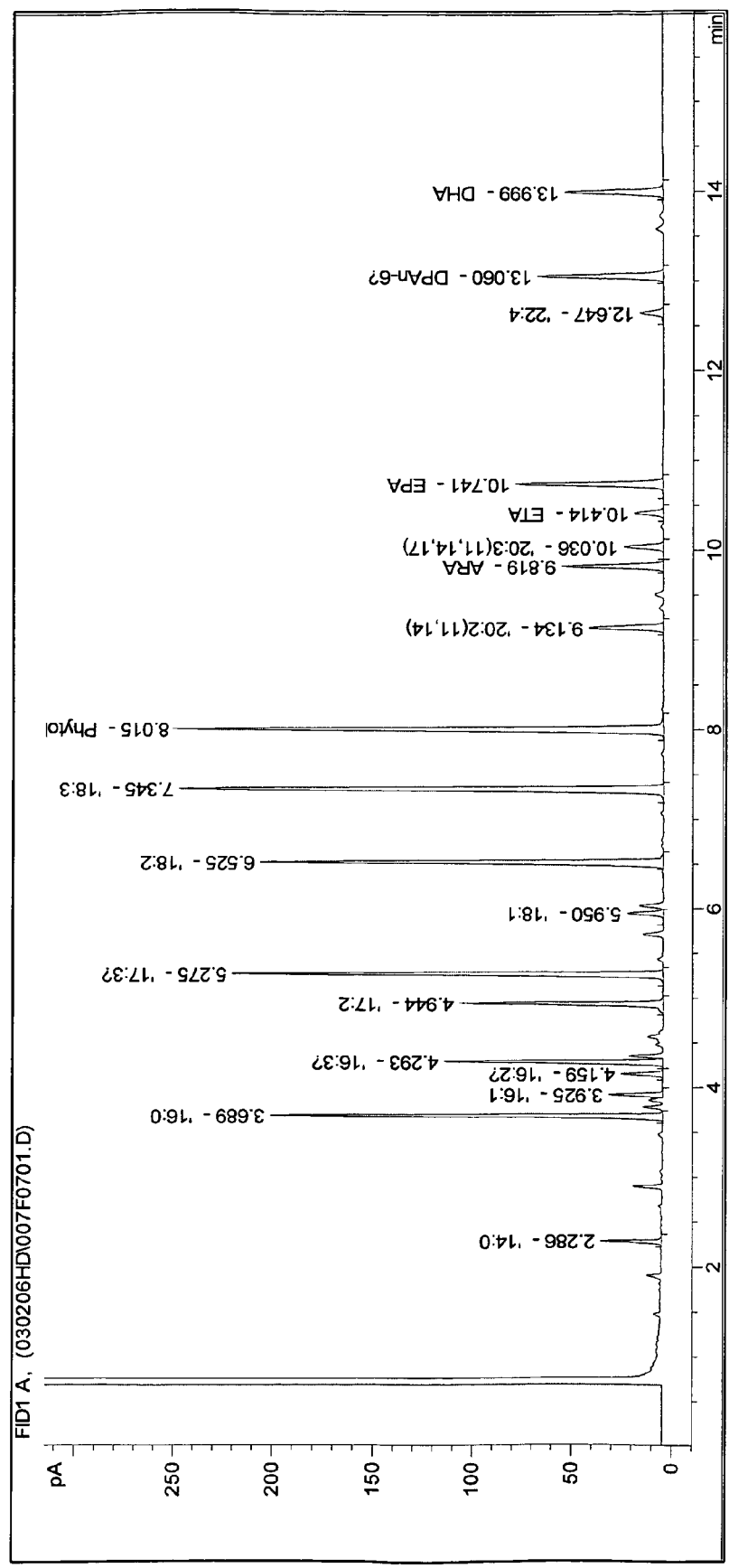
FIG. 12 shows a chromatogram of the lipid profile of a *Euglena anabaena* cell extract as described in the Examples.

Euglena anabaena was obtained from Dr. Richard Triemer's lab at Michigan State University (East Lansing, Mich.). Approximately 2 mL of culture were removed for lipid analysis and centrifuged at 1,800×g for 5 min. The pellet was washed once with water and re-centrifuged. The resulting pellet was dried for 5 min under vacuum, resuspended in 100 µL of trimethylsulfonium hydroxide (TMSH), and incubated at room temperature for 15 min with shaking. After this, 0.5 mL of hexane were added, and the vials were incubated for 15 min at room temperature with shaking. Fatty acid methyl esters (5 µL injected from hexane layer) were separated and quantified using a Hewlett-Packard 6890 Gas Chromatograph fitted with an Omegawax 320 fused silica capillary column (Supelco Inc., Cat. No. 24152). The oven temperature was programmed to hold at 170° C. for 1.0 min, increase to 240° C. at 5° C./min, and then hold for an additional 1.0 min. Carrier gas was supplied by a Whatman hydrogen generator. Retention times were compared to those for methyl esters of standards commercially available (Nu-Chek Prep, Inc. Cat. No. U-99-A), and the resulting chromatogram is shown in FIG. 12. The presence of EPA and DHA in the fatty acid profile suggested that Euglena anabaena would be a good source for long-chain PUFA biosynthetic genes such as, but not limited to, C20 elongases, delta-4 desaturases, and/or DHA synthases.

The remaining 5 mL of an actively growing culture was transferred into 25 mL of AF-6 Medium (Watanabe & Hiroki, NIES-Collection List of Strains, 5$^{th}$ ed., National Institute for Environmental Studies, Tsukuba, 127 pp (2004)) in a 125 mL glass flask. Euglena anabaena cultures were grown at 22° C. with a 16 hr light, 8 hr dark cycle for 2 weeks with very gentle agitation.

After 2 weeks, the culture (25 mL) was transferred to 100 mL of AF-6 medium in a 500 mL glass bottle, and the culture was grown for 1 month as described above. After this time, two 50 mL aliquots were transferred into two separate 500 mL glass bottles containing 250 mL of AF-6 medium, and the cultures were grown for two months as described above (giving a total of ~600 mL of culture). After this, the cultures were pelleted by centrifugation at 1,800×g for 10 min, washed once with water, and re-centrifuged. Total RNA was extracted from one of the resulting pellets using the RNA STAT-60™ reagent (TEL-TEST, Inc., Friendswood, Tex.) and following the manufacturer's protocol (use 5 mL of reagent, dissolved RNA in 0.5 mL of water). In this way, 340 µg of total RNA (680 µg/mL) were obtained from the pellet. The remaining pellet was frozen in liquid nitrogen and stored at −80° C. The mRNA was isolated from all 340 µg of total RNA using the mRNA Purification Kit (Amersham Biosciences, Piscataway, N.J.), following the manufacturer's protocol. In this way, 9.0 µg of mRNA were obtained.

Example 13

Euglena anabaena cDNA Synthesis, Library Construction and Identification of DHA Synthases from cDNA Library eug1c A cDNA library was generated using the Cloneminer™ cDNA Library Construction Kit (Cat. No. 18249-029, Invitrogen Corporation, Carlsbad, Calif.), following the manufacturer's protocol (Version B, 25-0608). Using the non-radiolabeling method, cDNA was synthesized from 5.12 µg of mRNA (Example 12) using the Biotin-attB2-Oligo(dT) primer. After synthesis of the first and second strand, the attB1 adapter was added; ligation was performed; and the cDNA was size fractionated using column chromatography. DNA from fractions were concentrated, recombined into pDONR™ 222, and transformed into E. coli ElectroMAX™ DH10B™ T1 Phage-Resistant cells (Invitrogen Corporation). The Euglena anabaena library was named eug1c.

Approximately 17,000 clones of cDNA library eug1c were plated onto 3 large square (24 cm×24 cm) petri plates (Corning, Corning, N.Y.), each containing LB+50 µg/mL kanamycin agar media. Cells were grown, transferred to Biodyne B membrane, and hybridized with a labeled NcoI/NotI DNA fragment, containing EgDHAsyn1*, from pY141, exactly as described in Example 5. In this way, 11 positive clones were identified (designated as eug1c-1 to eug1c-11).

The positive clones were grown, and DNA was purified and sequenced as described in Example 2 using vector-primed M13F Universal primer (SEQ ID NO:1), vector-primed M13-28Rev primer (SEQ ID NO:14), and the poly(A) tail-primed WobbleT oligonucleotides. Based on initial sequence data, additional internal fragment sequence was obtained in a similar way using oligonucleotides EaDHAsyn5' (SEQ ID NO:78), EaDHAsyn5'2 (SEQ ID NO:79), EaDHAsyn5'3 (SEQ ID NO:80), EaDHAsyn5'4 (SEQ ID NO:81), EaDHAsyn3' (SEQ ID NO:82), EaDHAsyn3'2 (SEQ ID NO:83), EaDHAsyn3'3 (SEQ ID NO:84), EaDHAsyn3'4 (SEQ ID NO:85), and EaDHAsyn3'5 (SEQ ID NO:86). In this way, the full insert sequences of the eug1c clones were obtained.

Sequences were aligned and compared using Sequencher™ (Version 4.2, Gene Codes Corporation, Ann Arbor, Mich.), and in this way, the clones could be categorized into one of four distinct groups based on insert sequence (identified as EaDHAsyn1 to EaDHAsyn4). Representative clones containing the cDNA for each class of sequence were chosen for further study, and sequences for each representative plasmid (i.e., pLF117-1, pLF117-2, pLF117-3 and pLF117-4) are shown as SEQ ID NO: 87, SEQ ID NO:88, SEQ ID NO:89, and SEQ ID NO:90, respectively. The sequence of pLF117-1 shown by a string of NNNN's represents a region of the polyA tail which was not sequenced. The coding sequences for EaDHAsyn1, EaDHAsyn2, EaDHAsyn3, and EaDHAsyn4 are shown as SEQ ID NO:91, SEQ ID NO:92, SEQ ID NO:93, and SEQ ID NO:94, respectively. The corresponding amino acid sequences for EaDHAsyn1, EaDHAsyn2, EaDHAsyn3, and EaDHAsyn4 are shown as SEQ ID NO:95, SEQ ID NO:96, SEQ ID NO:97, and SEQ ID NO:98, respectively.

The amino acid sequences for EaDHAsyn1 (SEQ ID NO:95), EaDHAsyn2 (SEQ ID NO:96), EaDHAsyn3 (SEQ ID NO:97), and EaDHAsyn4 (SEQ ID NO:98) were evaluated by BLASTP as described in Example 3 and, as was the case for EgDHAsyn1 (SEQ ID NO:12) and EgDHAsyn2 (SEQ ID NO:22), all four EaDHAsyn sequences were also found to be similar to both C20-PUFA Elo and delta-4 fatty acid desaturases. The N-termini of EaDHAsyn1 (SEQ ID NO:95), EaDHAsyn2 (SEQ ID NO:96), EaDHAsyn3 (SEQ ID NO:97), and EaDHAsyn4 (SEQ ID NO:98) each yielded a µ Log value of 58.5 (E value of 3e-59; 114/247 identical amino acids; 46% identity) versus the Pavlova sp. CCMP459 C20-PUFA Elo (SEQ ID NO:2). The C-termini of EaDHAsyn1 (SEQ ID NO:95), EaDHAsyn2 (SEQ ID NO:96), EaDHAsyn3 (SEQ ID NO:97), and EaDHAsyn4

(SEQ ID NO:98) yielded E values of 0.0 (378/538 identical amino acids; 70% identity), 0.0 (378/538 identical amino acids; 70% identity), 0.0 (379/538 identical amino acids; 70% identity), and 0.0 (368/522 identical amino acids; 70% identity), respectively, versus the amino acid sequence of delta-4 fatty acid desaturase from *Euglena gracilis* (SEQ ID NO:13). BLAST scores and probabilities indicate that the instant nucleic acid fragments encode entire *Euglena anabaena* C20-PUFA Elo/delta-4 fatty acid desaturases.

Figure 13A:
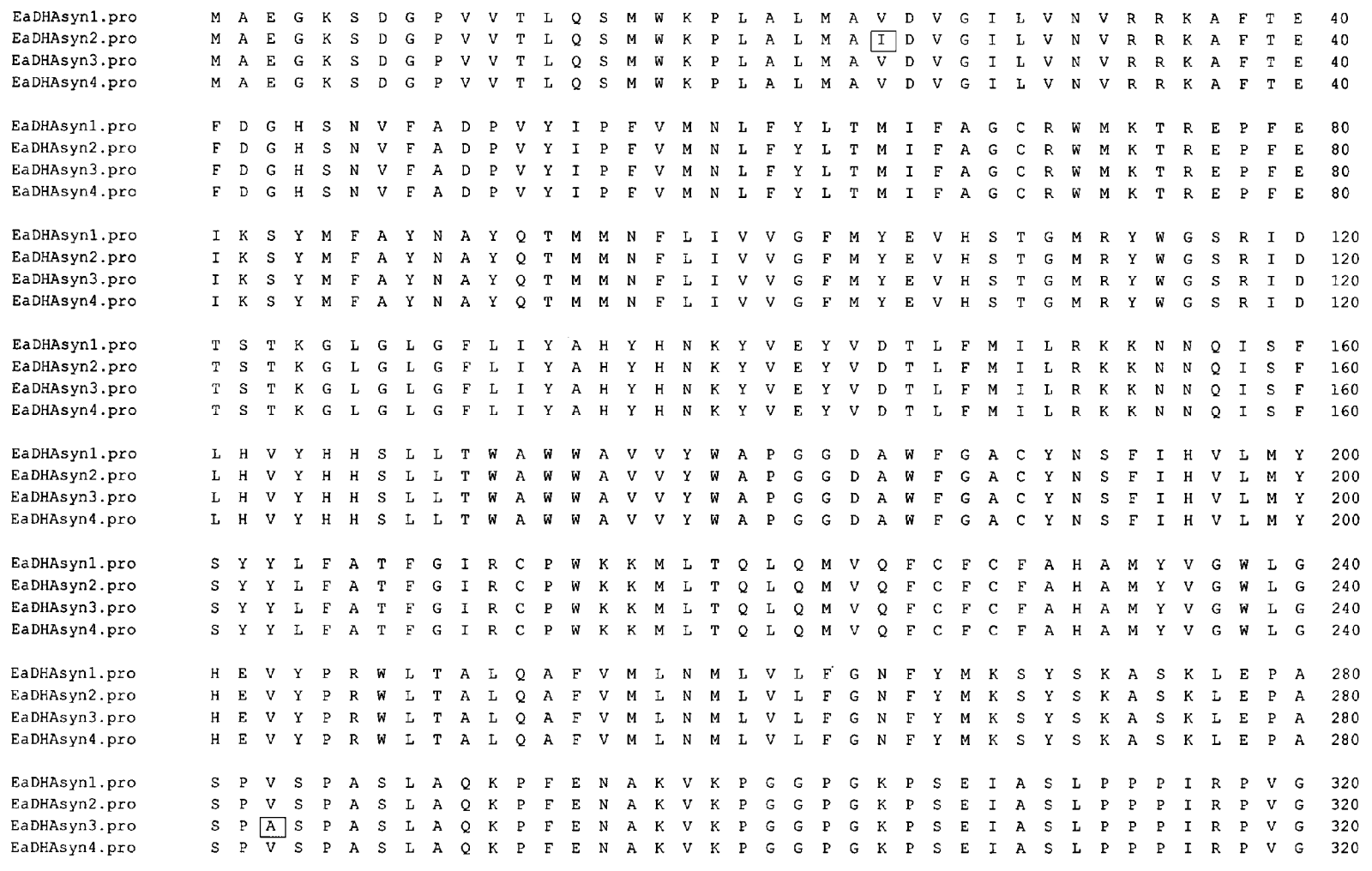
Figure 13B:
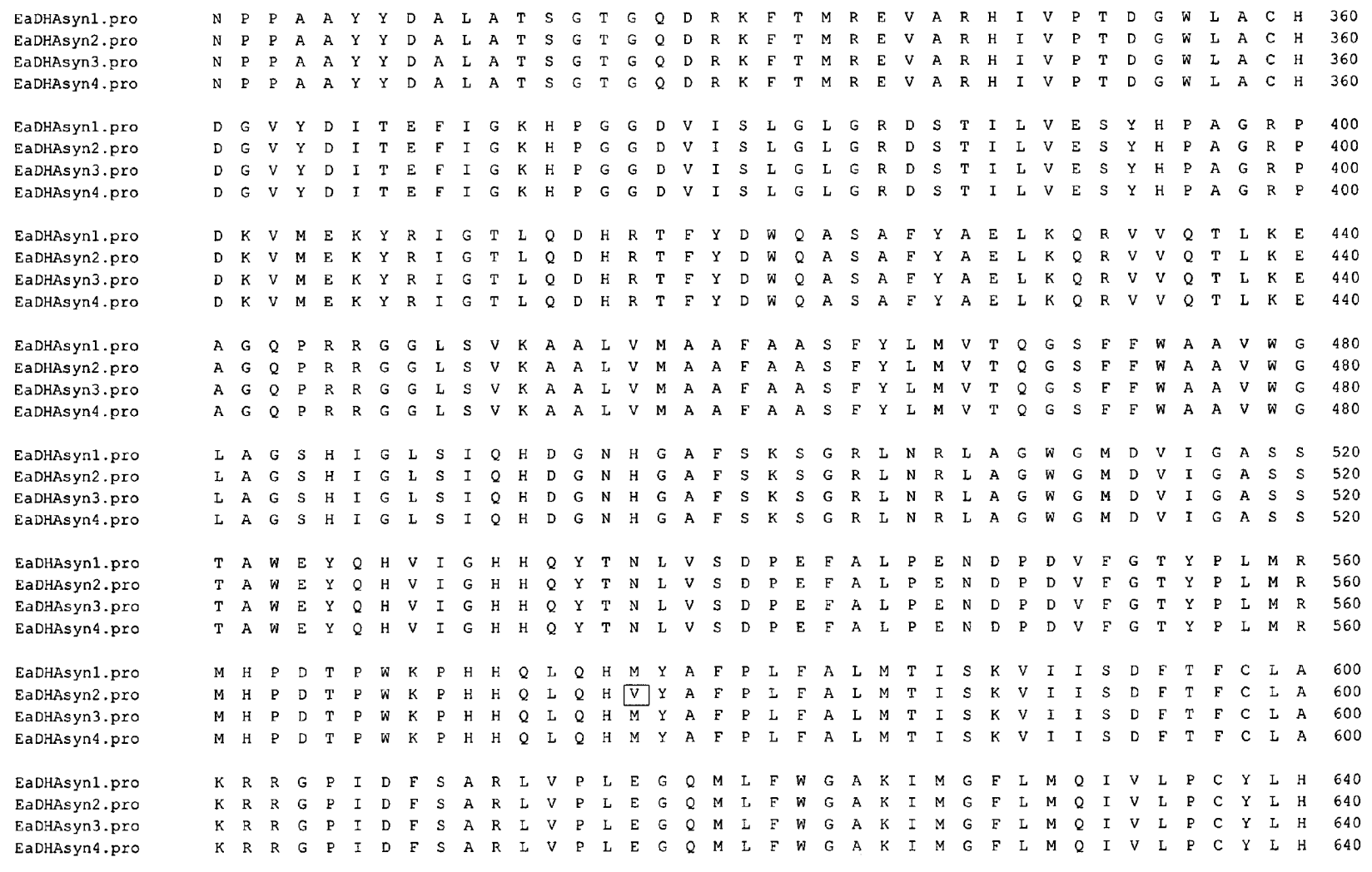

The amino acid sequences for EaDHAsyn1 (SEQ ID NO:95), EaDHAsyn2 (SEQ ID NO:96), EaDHAsyn3 (SEQ ID NO:97), and EaDHAsyn4 (SEQ ID NO:98) were compared using the Clustal W method as described in Example 6, and the alignment is shown in FIGS. 13A, 13B, and 13C. Interestingly, due to a single bp deletion in the nucleotide sequence, the C-terminus of the resulting amino acid sequence for EaDHAsyn4 (approximately last 35 amino acids) is highly divergent and smaller than the other three EaDHAsyn proteins.

When compared to the amino acid sequence of EgDHAsyn1 (SEQ ID NO:12) using BLASTP, the amino acid sequences of EaDHAsyn1 (SEQ ID NO:95), EaDHAsyn2 (SEQ ID NO:96), EaDHAsyn3 (SEQ ID NO:97), and EaDHAsyn4 (SEQ ID NO:98) were 70% ($^{558}/_{791}$), 70% ($^{558}/_{791}$), 70% ($^{559}/_{791}$) and 70% ($^{548}/_{775}$) identical, respectively.

As was the case for EgDHAsyn1 (SEQ ID NO:12) and EgDHAsyn2 (SEQ ID NO:22), all four EaDHAsyn sequences have a proline-rich linker region (from approximately P300 to T332 based on numbering for EaDHAsyn1). The linker appears to be slightly longer than that for EgDHAsyn1 (SEQ ID NO:12) or EgDHAsyn2 (SEQ ID NO:22). All four EaDHAsyn sequences also lack the NG repeat motif found upstream of the proline-rich motif of EgDHAsyn1 and EgDHAsyn2; but, this region, as was the case for EgDHAsyn1 and EgDHAsyn2, is also slightly proline-rich in all four EaDHAsyn sequences and may play a role in the linker function.

The nucleotide sequences for the C20 elongase domains of EaDHAsyn1, EaDHAsyn2, EaDHAsyn3, and EaDHAsyn4 are set forth in SEQ ID NO:227, SEQ ID NO:228, SEQ ID NO:229, and SEQ ID NO:230, respectively. The amino acid sequences for the C20 elongase domains of EaDHAsyn1, EaDHAsyn2, and EaDHAsyn3 are set forth in SEQ ID NO:231, SEQ ID NO:232, and SEQ ID NO:233, respectively. The amino acid sequence of the C20 elongase domain of EaDHAsyn4 is identical to that for EaDHAsyn1.

The nucleotide and amino acid sequences for the proline-rich linker of EaDHAsyn1 are set forth in SEQ ID NO:234 and SEQ ID NO:235, respectively. The nucleotide and amino acid sequences for the proline-rich linkers of EaDHAsyn2, EaDHAsyn3, and EaDHAsyn4 are identical to that for EaDHAsyn1.

The nucleotide sequences for the delta-4 desaturase domain 1 of each of EaDHAsyn1, EaDHAsyn2, and EaDHAsyn4 are set forth in SEQ ID NO:236, SEQ ID NO:237, and SEQ ID NO:238, respectively. The amino acid sequences for the delta-4 desaturase domains of EaDHAsyn1, EaDHAsyn2, and EaDHAsyn4 are set forth in SEQ ID NO:239, SEQ ID NO:240, and SEQ ID NO:241, respectively. The nucleotide and amino acid sequence of the delta-4 desaturase domain 1 of EaDHAsyn3 is identical to that of EaDHAsyn1.

The nucleotide sequences for the delta-4 desaturase domain 2 of EaDHAsyn1, EaDHAsyn2, EaDHAsyn3, and EaDHAsyn4, including the proline-rich linker and a portion of the 3' end of the C20 elongase domain, are set forth in SEQ ID NO:242, SEQ ID NO:243, SEQ ID NO:244, and SEQ ID NO:245, respectively. The amino acid sequences for the delta-4 desaturase domains of EaDHAsyn1, EaDHAsyn2, EaDHAsyn3, and EaDHAsyn4 are set forth in SEQ ID NO:246, SEQ ID NO:247, SEQ ID NO:248, and SEQ ID NO:249, respectively.

FIG. 29 summarizes the *Euglena anabaena* DHA synthase domain sequences.

Example 14

Construction of *Yarrowia lipolytica* Expression Vectors pY165, pY166, pY167 and pY168

Using the Gateway® LR Clonase™ II enzyme mix (Cat. No. 11791-020, Invitrogen Corporation) and following the manufacturer's protocol, the cDNA inserts from pLF117-1 (SEQ ID NO:87), pLF117-2 (SEQ ID NO:88), pLF117-3 (SEQ ID NO:89), and pLF117-4 (SEQ ID NO:90) were transferred to pY159 (SEQ ID NO:38; Example 8) to form pY165 (SEQ ID NO:99, FIG. 14A), pY166 (SEQ ID NO:100; FIG. 14B), pY167 (SEQ ID NO:101; FIG. 14C), and pY168 (SEQ ID NO:102; FIG. 14D), respectively. Thus, each plasmid contains the full length EaDHAsyn gene, under control of the *Yarrowia lipolytica* FBAINm promoter (PCT Publication No. WO 2005/049805; U.S. Pat. No. 7,202,356; labeled as "Yar Fba1 Pro+Intron" in FIG.), and the Pex20 terminator sequence from *Yarrowia* Pex20 gene (GenBank Accession No. AF054613).

Example 15

Construction of Soybean Expression Vector pKR1061 For Co-Expression of the *Euglena gracilis* DHA Synthase 1 (EgDHAsvn1) With the *Saprolegnia diclina* Delta-17 Desaturase (SdD17)

The present Example describes construction of a soybean vector for co-expression of EgDHAsyn1 (SEQ ID NO:12) with SdD17 and a hygromycin phosphotransferase selectable marker (hpt).

EgDHAsyn1 was amplified from pKR1049 (clone eeg1c.pk016.e6.f) with oligonucleotide primers oEGel2-1 (SEQ ID NO:103) and oEUG e14-3 (SEQ ID NO:44), using the Phusion™ High-Fidelity DNA Polymerase (Cat. No. F553S, Finnzymes Oy, Finland) following the manufacturer's protocol. The resulting DNA fragment was cloned into the pCR-Blunt® cloning vector using the Zero Blunt® PCR Cloning Kit (Invitrogen Corporation), following the manufacturer's protocol, to produce pKR1055 (SEQ ID NO:104).

A starting plasmid pKR72 (ATCC Accession No. PTA-6019; SEQ ID NO: 105, 7085 bp sequence), a derivative of pKS123 which was previously described in PCT Publication No. WO 2002/008269 (the contents of which are hereby incorporated by reference), contains the hygromycin B phosphotransferase gene (HPT) (Gritz, L. and Davies, J., Gene 25:179-188 (1983)), flanked by the T7 promoter and transcription terminator (T7prom/HPT/T7term cassette), and a bacterial origin of replication (ori) for selection and replication in bacteria (e.g., *E. coli*). In addition, pKR72 also contains HPT, flanked by the 35S promoter (Odell et al., *Nature* 313:810-812 (1985)) and NOS 3' transcription terminator (Depicker et al., *J. Mol. Appl. Genet.* 1:561-570 (1982)) (35S/HPT/NOS3' cassette), for selection in plants such as soybean. pKR72 also contains a NotI restriction site, flanked by the promoter for the α' subunit of β-conglycinin (Beachy et al., *EMBO J.* 4:3047-3053 (1985)) and the 3' transcription termination region of the phaseolin gene (Doyle et al., *J. Biol. Chem.* 261:9228-9238 (1986)), thus allowing for strong tissue-specific expression in the seeds of soybean of genes cloned into the NotI site.

The βcon/NotI/Phas3' cassette in plasmid pKR72 (SEQ ID NO:105, having ATCC Accession No. PTA-6019) was amplified using oligonucleotide primers oCon-1 (SEQ ID NO:106) and oCon-2 (SEQ ID NO:107) using the VentR® DNA Polymerase (Catalog No. M0254S, New England Biolabs Inc., Beverly, Mass.) following the manufacturer's protocol. The resulting DNA fragment was digested with XbaI and cloned into the XbaI site of pUC19, to produce pKR179 (SEQ ID NO:108).

EgDHAsyn1 was released from pKR1055 (SEQ ID NO:104) by digestion with NotI and was cloned into the NotI site of plasmid pKR179 (SEQ ID NO:108) to produce pKR1057 (SEQ ID NO:109).

The SbfI fragment of pKR1057 (SEQ ID NO:109), containing the βcon/EgDHAsyn1/Phas3' cassette was cloned into the SbfI site of pKR328 (SEQ ID NO:110; which is described in PCT Publication No. WO 2004/071467 and the contents of which are hereby incorporated by reference), containing SdD17, to produce vector pKR1061 (SEQ ID NO:111). A schematic depiction of pKR1061 is shown in FIG. 15A.

Example 16

Construction of Soybean Expression Vector pKR973 For Co-Expression of the *Pavlova lutheri* Delta-8 Desaturase (PavD8) With the *Euglena gracilis* Delta-9 Elongase (EqD9elo) and the *Mortierella alpina* Delta-5 Desaturase (MaD5)

*Euglena gracilis* delta-9 elongase (EgD9elo):

A clone from the Euglena cDNA library (eeg1c), called eeg1c.pk001.n5f, containing the *Euglena gracilis* delta-9 elongase (EgD9elo; SEQ ID NO:112; which is described in U.S. application Ser. No. 11/601,563 (filed Nov. 16, 2006, which published May 24, 2007 as US-2007-0118929-A1) the contents of which are hereby incorporated by reference) was used as template to amplify EgD9elo with oligonucleotide primers oEugEL1-1 (SEQ ID NO:113) and oEugEL1-2 (SEQ ID NO:114) using the VentR® DNA Polymerase (Cat. No. M0254S, New England Biolabs Inc., Beverly, Mass.) following the manufacturer's protocol. The resulting DNA fragment was cloned into the pCR-Blunt® cloning vector using the Zero Blunt® PCR Cloning Kit (Invitrogen Corporation), following the manufacturer's protocol, to produce pKR906 (SEQ ID NO:115).

Plasmid pKR906 was digested with NotI, and the fragment containing the *Euglena gracilis* delta-9 elongase was cloned into plasmid pKR132 (SEQ ID NO:116; which is described in PCT Publication No. WO 2004/071467) to produce pKR953 (SEQ ID NO:117).

*Mortierella alpina* delta-5 desaturase (MaD5):

Vector pKR287 (SEQ ID NO:118; which is described in PCT Publication No. WO 2004/071467, published Aug. 26, 2004; the contents of which are hereby incorporated by reference), contains the *Mortierella alpina* delta-5 desaturase (MaD5; SEQ ID NO:119, which is described in U.S. Pat. No. 6,075,183 and PCT Publication Nos. WO 2004/071467 and WO 2005/047479, the contents of which are hereby incorporated by reference), flanked by the soybean glycinin Gy1 promoter and the pea legumin A2 3' termination region (Gy1/MaD5/legA2 cassette). Vector pKR287 was digested with SbfI/BsiWI, and the fragment containing the Gy1/MaD5/legA2 cassette was cloned into the SbfI/BsiWI fragment of pKR277 (SEQ ID NO:120; which is described in PCT Publication No. WO 2004/071467, the contents of which are hereby incorporated by reference) to produce pK952 (SEQ ID NO:121).

Vector pKR457 (SEQ ID NO:122), which was previously described in PCT Publication No. WO 2005/047479 (the contents of which are hereby incorporated by reference), contains a NotI site flanked by the Kunitz soybean Trypsin Inhibitor (KTi) promoter (Jofuku et al., *Plant Cell* 1:1079-1093 (1989)) and the KTi 3' termination region, the isolation of which is described in U.S. Pat. No. 6,372,965, followed by the soy albumin transcription terminator, which was previously described in PCT Publication No. WO 2004/071467 (Kti/NotI/Kti3'Salb3' cassette). Through a number of subcloning steps, sequences containing Asp718 restriction sites were added to the 5' and 3' ends of the Kti/NotI/Kti3' Salb3' cassette to produce SEQ ID NO:123.

*Pavlova lutheri* Delta-8 Desaturase (PavD8):

*Pavlova lutheri* (CCMP459) was obtained from the Culture of Marine Phytoplankton (CCMP, West Boothbay Harbor, Me.) and grown in 250 mL flasks containing 50 mL of F/2-Si medium (made using F/2 Family Medium Kit-KIT20F2 and Filtered Seqwater-SEA2 from CCMP) at 26° C. with shaking at 150 rpm. Cultures were transferred to new medium on a weekly basis using a 1:4 (old culture:new medium) dilution.

Cultures from 28 flasks (1400 mL) were combined, and cells were pelleted by centrifugation at 1,800×g for 10 min, washed once with water, and re-centrifuged. Total RNA was extracted from the resulting pellet using the RNA STAT-60™ reagent (TEL-TEST, Inc., Friendswood, Tex.), following the manufacturer's protocol. In this way, 2.6 mg of total RNA (2.6 mg/mL) were obtained from the pellet. The mRNA was isolated from 1.25 mg of total RNA using the mRNA Purification Kit (Amersham Biosciences, Piscataway, N.J.), following the manufacturer's protocol. In this way, 112 µg of mRNA were obtained.

cDNA was synthesized from 224 ng of mRNA using the SuperScript™ First-Strand Synthesis System for RT-PCR Kit (Invitrogen™ Life Technologies, Carlsbad, Calif.) with the provided oligo(dT) primer, according to the manufacturer's protocol. After RNase H treatment as per the protocol, the *Pavlova lutheri* delta-8 desaturase (PavD8; SEQ ID NO:124; which is described in U.S. patent application Ser. No. 11/737,772 (filed Apr. 20, 2007) the contents of which are hereby incorporated by reference) was amplified from the resulting cDNA with oligonucleotide primers PvDES5'Not-1 (SEQ ID NO:125) and PvDES3'Not-1 (SEQ ID NO:126) using the conditions described below.

cDNA (2 µL) from the reaction described above was combined with 50 pmol of PvDES5'Not-1 (SEQ ID NO:125), 50 pmol of PvDES3'Not-1 (SEQ ID NO:126), 1 µL of PCR nucleotide mix (10 mM, Promega, Madison, Wis.), 5 µL of 10×PCR buffer (Invitrogen Corporation), 1.5 µL of MgCl$_2$ (50 mM, Invitrogen Corporation), 0.5 µL of Taq polymerase (Invitrogen Corporation), and water to 50 µL. The reaction conditions were 94° C. for 3 min followed by 35 cycles of 94° C. for 45 sec, 55° C. for 45 sec, and 72° C. for 1 min. The PCR was finished at 72° C. for 7 min, and then held at 4° C. The PCR reaction was analyzed by agarose gel electrophoresis on 5 µL, and a DNA band with molecular weight around 1.3 kb was observed. The remaining product was separated by agarose gel electrophoresis, and the DNA was purified using the Zymoclean™ Gel DNA Recovery Kit (Zymo Research, Orange, Calif.), following the manufacturer's protocol.

The PavD8, flanked by NotI sites, was cloned into the NotI site of the modified Kti/NotI/Kti3'Salb3' cassette (SEQ ID NO:123), and then the DNA fragment was digested with Asp718 and cloned into the SbfI site of pKR952 (SEQ ID NO:121) to produce pKR970 (SEQ ID NO:127).

Plasmid pKR953 (SEQ ID NO:117) was digested with PstI, and the fragment containing the *Euglena gracilis* delta-9 elongase was cloned into the SbfI site of pKR970 (SEQ ID NO:127) to produce pKR973 (SEQ ID NO:128, FIG. 15B).

In this way, the *Pavlova lutheri* delta-8 desaturase could be co-expressed with the *Mortierella alpina* delta-5 desaturase and the *Euglena gracilis* delta-9 elongase behind strong, seed-specific promoters.

Example 17

Construction of Soybean Expression Vector pKR1064 For Co-Expression of the *Euglena gracilis* DHA Synthase 1 (EqDHAsvn1) With the *Saprolegnia diclina* Delta-17 Desaturase (SdD17)

The present Example describes construction of a soybean vector for co-expression of EgDHAsyn1 with SdD17 and the acetolactate synthase (ALS) selectable marker.

The PstI fragment, containing the Ann/Sdd17/BD30 cassette from pKR271 (SEQ ID NO:129; which is described in PCT Publication No. WO 2004/071467 and the contents of which are hereby incorporated by reference), was cloned into the SbfI site of pKR226 (SEQ ID NO:130; which is also described in PCT Publication No. WO 2004/071467) to produce vector pKR886r (SEQ ID NO:131). In this way, the *Saprolegnia diclina* delta-17 desaturase (SdD17) was cloned behind the annexin promoter which is strong and seed specific.

The SbfI fragment of pKR1057 (SEQ ID NO:109), containing the βcon/EgDHAsyn1/Phas3' cassette, was cloned into the SbfI site of pKR886r (SEQ ID NO:131), containing SdD17, to produce vector pKR1064 (SEQ ID NO:132). A schematic depiction of pKR1064 is shown in FIG. 15C.

Example 18

Construction of Soybean Expression Vector pKR1133 For Co-Expression of the *Euglena gracilis* DHA Synthase 1 (EgDHAsvn1) With the *Euglena gracilis* Delta-9 Elongase (EqD9elo) and the *Mortierella alpina* Delta-5 Desaturase (MaD5)

The glycinin Gy1 promoter was PCR amplified from pZBL119 (SEQ ID NO:133; which is described in PCT Publication No. WO 2004/071467 and the contents of which are hereby incorporated by reference) using primers oSGly-2 (SEQ ID NO:134) and oSGly-3 (SEQ ID NO:135). The resulting PCR fragment was subcloned into the intermediate cloning vector pCR-Script AMP SK(+) (Stratagene), according to the manufacturer's protocol, to produce plasmid pPSgly32 (SEQ ID NO:136).

The PstI/NotI fragment of plasmid pSGly32 (SEQ ID NO:136), containing the Gy1 promoter, was cloned into the PstI/NotI fragment from plasmid pKR142 (SEQ ID NO:137; which is described in PCT Publication No. WO 2004/071467 and the contents of which are hereby incorporated by reference), containing the leguminA2 3' transcription termination region, an ampicillin resistance gene, and bacterial ori, to produce pKR264 (SEQ ID NO:138). Thus, vector pKR264 contains a NotI site flanked by the promoter for the glycinin Gy1 gene and the leguminA23' transcription termination region (Gy1/NotI/legA2 cassette).

EgDHAsyn1 was released from pKR1055 (SEQ ID NO:104; Example 15) by digestion with NotI and was cloned into the NotI site of plasmid pKR264 (SEQ ID NO:138), to produce pKR1128 (SEQ ID NO:139).

The NotI fragment of pKS129 (SEQ ID NO:140; which is described in PCT Publication No. WO 2004/071467 and the contents of which are hereby incorporated by reference), containing the MaD5 was cloned into the NotI site of pKR457 (SEQ ID NO:122; Example 16), to produce pKR606 (SEQ ID NO:141).

Vector pKR606 (SEQ ID NO:141) was digested with BsiWI and after filling to blunt the ends, the fragment containing the Gy1/MaD5/legA2 cassette was cloned into the filled NgoMI site of pKR277 (SEQ ID NO:120) to produce pKR804 (SEQ ID NO:142).

The BsiWI fragment from pKR1128 (SEQ ID NO:139), containing the Gy1/EgDHAsyn1/legA2 cassette, was cloned into the BsiWI site of pKR804 (SEQ ID NO:142) to produce pKR1130 (SEQ ID NO:143).

Plasmid pKR953 (SEQ ID NO:117) was digested with BsiWI; ends were blunted by filling; and pKR953 was then digested with BamHI. The filled BsiWI/BamHI fragment of pKR953, containing the Salb/EgD9Elo/Phas3' cassette, was cloned into the PmeI/BamHI sites of pNEB193 (New England Biolabs, Ipswich, Mass.) to produce pKR1131 (SEQ ID NO:144).

Plasmid pKR1131 (SEQ ID NO:144) was digested with PstI and the fragment containing the *Euglena gracilis* delta-9 elongase was cloned into the SbfI site of pKR1130 (SEQ ID NO:143) to produce pKR1133 (SEQ ID NO:145, FIG. 15D).

In this way, the *Euglena gracilis* DHA synthase 1 could be co-expressed with the *Mortierella alpina* delta-5 desaturase and the *Euglena gracilis* delta-9 elongase behind strong, seed-specific promoters.

Example 19

Construction of Soybean Expression Vector pKR1105 For Co-Expression of the *Euglena gracilis* DHA Synthase 1 C20 Elongase Domain (EqDHAsyn1 C20EloDom1) with the *Schizochytrium aggregatum* Delta-4 Desaturase (SaD4)

The βcon/NotI/Phas cassette was PCR amplified from pKS123 (SEQ ID NO:146; which is described in PCT Publication No. WO 2004/071467 and the contents of which are hereby incorporated by reference) using primers oKti5 (SEQ ID NO:147) and oKti6 (SEQ ID NO:148). The resulting PCR fragment was digested with BsiWI and cloned into the BsiWI site of pKR124 (SEQ ID NO:149; which is described in PCT Publication No. WO 2004/071467 and the contents of which are hereby incorporated by reference), containing the bacterial origin of replication and selection, to produce plasmid pKR193 (SEQ ID NO:150).

EgDHAsyn1C20Elodom1 was released from pHD16 (SEQ ID NO:51; Example 10) by digestion with NotI and was cloned into the NotI site of plasmid pKR193 (SEQ ID NO:150) to produce pKR1103 (SEQ ID NO:151).

The BsiWI fragment, containing the EgDHAsyn1C20Elodom1, was released from pKR1103 (SEQ ID NO:151) and was cloned into the BsiWI site of pKR226 (SEQ ID NO:130; Example 17) to produce vector pKR1104 (SEQ ID NO:152).

Vector pKR300 (SEQ ID NO:153; which is described in PCT Publication No. WO 2004/071467, published Aug. 26, 2004; the contents of which are hereby incorporated by reference), contains the *Schizochytrium aggregatum* delta-4 desaturase (SaD4), which is described in U.S. Pat. No. 7,045,683 and PCT Publication No WO 02/090493, the contents of which are hereby incorporated by reference), flanked by the NotI restriction sites. The AscI site present within the SaD4 was removed without affecting the corresponding amino acid sequence to produce a new sequence (SEQ ID NO:154) which remains flanked by the NotI sites. The NotI fragment (SEQ ID NO:154) was cloned into the NotI site of plasmid pKR457 (SEQ ID NO:122; Example 16) to produce pKR1102 (SEQ ID NO:155).

Plasmid pKR1102 (SEQ ID NO:155) was digested with PstI, and the fragment containing the SaD4 was cloned into the SbfI site of pKR1104 (SEQ ID NO:152) to produce pKR1105 (SEQ ID NO:156; FIG. 16A). In this way, the *Euglena gracilis* DHA synthase 1 C20 elongase domain could be co-expressed with the *Schizochytrium aggregatum* delta-4 desaturase behind strong, seed-specific promoters.

Example 20

Construction of Soybean Expression Vector pKR1134 for Expression of the *Euglena gracilis* DHA Synthase 1 C20 Elongase Domain/*Schizochytrium aggregatum* Delta-4 Desaturase Fusion (EqDHAsyn1C20EloDom3-SaD4)

EgDHAsyn1C20EloDom3 was amplified from pKR1091 with oligonucleotide primers EgEPAEloDom-5 (SEQ ID NO:43) and oEUGsyn6-4 (SEQ ID NO:157) using the Phusion™ High-Fidelity DNA Polymerase (Cat. No. F553S, Finnzymes Oy, Finland) following the manufacturer's protocol. The resulting DNA fragment was cloned into the pCR-Blunt® cloning vector using the Zero Blunt® PCR Cloning Kit (Invitrogen Corporation), following the manufacturer's protocol, to produce pKR1107 (SEQ ID NO:158).

Plasmid pKR1107 (SEQ ID NO:158) was digested with NotI, and the fragment containing the EgDHAsyn1C20EloDom3 was religated to form pKR1112 (SEQ ID NO:159).

The XbaI/PstI DNA fragment from pKR1112 (SEQ ID NO:159), containing EgDHAsyn1 C20EloDom3, was cloned into the XbaI/SbfI DNA fragment from pKR1068 (SEQ ID NO:75; Example 11), containing the SaD4, to produce pKR1115 (SEQ ID NO:160). In this way, the EgDHAsyn1C20Elodom3-SaD4 was re-created without an internal SbfI site but codes for an identical amino acid sequence as that described in Example 11.

EgDHAsyn1C20Elodom3-SaD4 was released from pKR1115 (SEQ ID NO:160) by digestion with NotI and was cloned into the NotI site of plasmid pKR1104 (SEQ ID NO:152), containing an ALS selectable marker, to produce pKR1134 (SEQ ID NO:161; FIG. 16B).

Example 21

Construction of Soybean Expression Vector pKR1095 for Co-Expression of the *Tetruetreptia pomquetensis* CCMP1491 Delta-8 Desaturase (TpomD8) With the *Saprolegnia diclina* Delta-17 Desaturase (SdD17)

The present Example describes construction of a soybean vector for co-expression of TpomD8 with SdD17 and a hygromycin phosphotransferase selectable marker (hpt).

*Tetruetreptia pomquetensis* CCMP1491 cells (from 1 liter of culture) were purchased from the Provasoli-Guillard National Center for Culture of Marine Phytoplakton (CCMP) (Bigelow Laboratory for Ocean Sciences, West Boothbay Harbor, Me.). Total RNA was isolated using the trizol reagent (Invitrogen, Carlsbad, Calif.), according to the manufacturer's protocol. The cell pellet was resuspended in 0.75 mL of trizol reagent, mixed with 0.5 mL of 0.5 mm glass beads, and homogenized in a Biospec mini beadbeater (Bartlesville, Okla.) at the highest setting for 3 min. The mixture was centrifuged in an Eppendorf centrifuge for 30 sec at 14,000 rpm to remove debri and glass beads. Supernatant was extracted with 150 µL of 24:1 chloroform:isoamy alcohol. The upper aqueous phase was used for RNA isolation.

For RNA isolation, the aqueous phase was mixed with 0.375 mL of isopropyl alcohol and allowed to incubate at room temperature for 5 min. Precipitated RNA was collected by centrifugation at 8,000 rpm and kept at 4° C. for 5 min. The pellet was washed once with 0.7 mL of 80% ethanol and air dried. Thus, 95 µg of total RNA were obtained from *Tetruetreptia pomquetensis* CCMP1491.

Total RNA (0.95 µg of total RNA in 1 µL) was used as template to synthesize double stranded cDNA. The Creator™ SMART™ cDNA Library Construction Kit from BD Bioscience Clontech (Palo Alto, Calif.) was used. Total RNA (1 µL) was mixed with 1 µL of SMART IV oligonucleotide (SEQ ID NO:181) 1 µL of the Adaptor Primer from Invitrogen 3'-RACE kit (SEQ ID NO:182), and 2 µL of water. The mixture was heated to 75° C. for 5 min and then cooled on ice for 5 min. To the mixture was added: 2 µL of 5× first strand buffer, 1 µL 20 mM DTT, 1 µL of dNTP mix (10 mM each of dATP, dCTP, dGTP and dTTP), and 1 µL of PowerScript reverse transcriptase. The sample was incubated at 42° C. for 1 h. The resulting first strand cDNAs were then used as templates for amplification.

The *Tetruetreptia pomquetensis* CCMP1491 delta-8 desaturase (TpomD8; SEQ ID NO:162; which is described in U.S. patent application Ser. No. 11/876,115 (filed Oct. 22, 2007) the contents of which are hereby incorporated by reference) was amplified from the cDNA with oligonucleotide primers TpomNot-5 (SEQ ID NO:163) and TpomNot-3 (SEQ ID NO:164) using Taq polymerase (Invitrogen Corporation) following the manufacturer's protocol.

*Tetruetreptia pomquetensis* CCMP1491 cDNA (1 µL) was combined with 50 pmol of TpomNot-5 (SEQ ID NO:163), 50 pmol of TpomNot-3 (SEQ ID NO:164), 1 µL of PCR nucleotide mix (10 mM, Promega, Madison, Wis.), 5 µL of 10×PCR buffer (Invitrogen Corporation), 1.5 µL of $MgCl_2$ (50 mM, Invitrogen Corporation), 0.5 µL of Taq polymerase (Invitrogen Corporation) and water to 50 µL. The reaction conditions were 94° C. for 3 min followed by 35 cycles of 94° C. for 45 sec, 55° C. for 45 sec and 72° C. for 1 min. The PCR was finished at 72° C. for 7 min and then held at 4° C. 5 µL of the PCR reaction were analyzed by agarose gel electrophoresis, and a DNA band with molecular weight around 1.3 kb was observed.

The remaining product was separated by agarose gel electrophoresis, and the DNA was purified using the Zymoclean™ Gel DNA Recovery Kit (Zymo Research, Orange, Calif.), following the manufacturer's protocol. The resulting DNA was cloned into the PGEM®-T Easy Vector (Promega), following the manufacturer's protocol, to produce pLF114-10 (SEQ ID NO:165).

TpomD8 was released from pLF114-10 (SEQ ID NO:165) by digestion with NotI and was cloned into the NotI site of plasmid pKR179 (SEQ ID NO:108; Example 15) to produce pKR1002 (SEQ ID NO:166).

The PstI fragment of pKR1002 (SEQ ID NO:166), containing the βcon/TpomD8/Phas3' cassette was cloned into the SbfI site of pKR328 (SEQ ID NO:110; Example 15), containing the SdD17, to produce vector pKR1095 (SEQ ID NO:167). A schematic depiction of pKR1095 is shown in FIG. 16C.

Example 22

Construction of Soybean Expression Vector pKR1132 for Co-Expression of the *Tetruetreptia pomquetensis* CCMP1491 Delta-8 Desaturase (TpomD8) with the *Euglena gracilis* Delta-9 Elongase (EqD9elo) and the *Mortierella alpina* Delta-5 Desaturase (MaD5)

TPomD8 was released from pLF114-10 (SEQ ID NO:165; Example 21) by digestion with NotI and was cloned into the NotI site of plasmid pKR264 (SEQ ID NO:138; Example 18) to produce pKR1127 (SEQ ID NO:168).

The BsiWI fragment from pKR1127 (SEQ ID NO:168), containing the Gy1/TPomD8/legA2 cassette, was cloned into the BsiWI site of pKR804 (SEQ ID NO:142; Example 18) to produce pKR1129 (SEQ ID NO:169).

Plasmid pKR1131 (SEQ ID NO:144; Example 18) was digested with PstI, and the fragment containing the *Euglena gracilis* delta-9 elongase was cloned into the SbfI site of pKR1129 (SEQ ID NO:169) to produce pKR1132 (SEQ ID NO:170, FIG. 16D). In this way, the *Tetruetreptia pomquetensis* delta-8 desaturase could be co-expressed with the *Mortierella alpina* delta-5 desaturase and the *Euglena gracilis* delta-9 elongase behind strong, seed-specific promoters.

Example 23

Construction of Soybean Expression Vector KS373 for Expression of a *Euglena gracilis* Delta-9 Elongase/Euglena gracilis DHA Synthase 1 Linker/*Pavlova lutheri* Delta-8 Desaturase Fusion (EqD9elo-EqDHAsyn1 Link-PavD8)

An in-frame fusion between the *Euglena gracilis* delta-9 elongase (EgD9elo; Example 16; SEQ ID NO:112), the *Euglena gracilis* DHA synthase 1 proline-rich linker (EgDHAsyn1 Link; SEQ ID NO:171; described in Example 6 and shown in FIG. 6), and the *Pavlova lutheri* delta-8 desaturase (PavD8; Example 16; SEQ ID NO:124) was constructed using the conditions described below.

An initial in-frame fusion between the EgD9elo and the EgDHAsyn1 Link (EgD9elo-EgDHAsyn1 Link) was made, flanked by a NcoI site at the 5' end and a NotI site at the 3' end, by PCR amplification. EgD9elo (SEQ ID NO:112) was amplified with oligonucleotides MWG507 (SEQ ID NO:172) and MWG509 (SEQ ID NO:173), using the Phusion™ High-Fidelity DNA Polymerase (Cat. No. F553S, Finnzymes Oy, Finland), following the manufacturer's protocol. EgDHAsyn1 Link (SEQ ID NO:171) was amplified in a similar way with oligonucleotides MWG510 (SEQ ID NO:174) and MWG511 (SEQ ID NO:175). The two resulting PCR products were combined and re-amplifed using MWG507 (SEQ ID NO:172) and MWG511 (SEQ ID NO:175) to form EgD9elo-EgDHAsyn1 Link. The sequence of the EgD9elo-EgDHAsyn1 Link is shown in SEQ ID NO:176. EgD9elo-EgDHAsyn1 Link does not contain an in-frame stop codon upstream of the NotI site at the 3' end, and therefore, a DNA fragment cloned into the NotI site can give rise to an in-frame fusion with the EgD9elo-EgDHAsyn1 Link.

Plasmid KS366 (SEQ ID NO:177) contains unique NcoI and NotI restriction sites, flanked by the promoter for the α' subunit of β-conglycinin (Beachy et al., *EMBO J.* 4:3047-3053 (1985)) and the 3' transcription termination region of the phaseolin gene (Doyle et al., *J. Biol. Chem.* 261:9228-9238 (1986)). Other than the replacement of the unique NotI site in pKR72 (SEQ ID NO:105) with a unique NcoI/NotI multiple cloning site, the Bcon/NcoINotI/Phas3' cassette in KS366 is identical to that found in pKR72 (SEQ ID NO:105), except that the flanking HindIII sites were replaced by BamHI sites. The Bcon/NcoINotI/Phas3' cassette of KS366 was cloned into the BamHI site of pBluescript II SK(+) vector (Stratagene).

The NcoI/NotI DNA fragment, containing EgD9elo-EgDHAsyn1 Link (SEQ ID NO:176), was cloned into the NcoI/NotI DNA fragment from KS366 (SEQ ID NO:177), containing the promoter for the α' subunit of β-conglycinin, to produce KS366-EgD9elo-EgDHAsyn1 Link (SEQ ID NO:178).

The NotI fragment containing PavD8 (generated as described in Example 16) was cloned into the NotI fragment of KS366-EgD9elo-EgDHAsyn1 Link (SEQ ID NO:178) to produce KS373 (SEQ ID NO:179; FIG. 17).

Example 24

Construction of Alternate Soybean Expression Vectors for Expression of DHA Synthases, C20 Elongase Domains, Delta-4 Desaturase Domains, Synthetic C20 Elongase/Delta-4 Desaturase Fusion Proteins and Other Synthetic Elongase/Desaturase Fusion Proteins In addition to the genes, promoters, terminators and gene cassettes described herein, one skilled in the art can appreciate that other promoter/gene/terminator cassette combinations can be synthesized in a way similar to, but not limited to, that described herein for expression of EgDHAsyn1. Similarly, it may be desirable to express other PUFA genes (such as those described in Table 23), for co-expression with any of the DHA synthases of the present invention or DHA synthase domains (i.e., C20 elongase domain or delta-4 desaturase domain expressed individually). Additionally, synthetic fusions between an elongase domain and a desaturase domain separated by a suitable linker region could be made and expressed. For instance, a synthetic fusion between a C20 elongase (or C20 elongase domain from a DHA synthase) and a suitable delta-4 desaturase (or delta-4 desaturase domain from a DHA synthase) could be made and expressed. Alternatively, other elongases or desaturases could be used such as, but not limited to, the synthetic fusion described herein between a delta-9 elongase and delta-8 desaturase separated by a linker from a DHA synthase (i.e., Example 23).

For instance, PCT Publication Nos. WO 2004/071467 and WO 2004/071178 describe the isolation of a number of promoter and transcription terminator sequences for use in embryo-specific expression in soybean. Furthermore, PCT Publication Nos. WO 2004/071467, WO 2005/047479 and WO 2006/012325 describe the synthesis of multiple promoter/gene/terminator cassette combinations by ligating individual promoters, genes, and transcription terminators together in unique combinations. Generally, a NotI site flanked by the suitable promoter (such as those listed in, but not limited to, Table 21) and a transcription terminator (such as those listed in, but not limited to, Table 22) is used to clone the desired gene. NotI sites can be added to a gene of interest such as those listed in, but not limited to, Table 23 using PCR amplification with oligonucleotides designed to introduce NotI sites at the 5' and 3' ends of the gene. The resulting PCR product is then digested with NotI and cloned into a suitable promoter/NotI/terminator cassette.

In addition, PCT Publication Nos. WO 2004/071467, WO 2005/047479 and WO 2006/012325 describe the further linking together of individual gene cassettes in unique combinations, along with suitable selectable marker cassettes, in order to obtain the desired phenotypic expression. Although this is done mainly using different restriction enzymes sites, one skilled in the art can appreciate that a number of techniques can be utilized to achieve the desired promoter/gene/transcription terminator combination. In so doing, any combination of embryo-specific promoter/gene/transcription terminator cassettes can be achieved. One skilled in the art can also appreciate that these cassettes can be located on individual DNA fragments or on multiple fragments where co-expression of genes is the outcome of co-transformation of multiple DNA fragments.

TABLE 21

Seed-specific Promoters

| Promoter | Organism | Promoter Reference |
| --- | --- | --- |
| β-conglycinin α'-subunit | soybean | Beachy et al., EMBO J. 4: 3047-3053 (1985) |
| kunitz trypsin inhibitor | soybean | Jofuku et al., Plant Cell 1: 1079-1093 (1989) |
| Annexin | soybean | WO 2004/071467 |
| glycinin Gy1 | soybean | WO 2004/071467 |
| albumin 2S | soybean | U.S. Pat. No. 6,177,613 |
| legumin A1 | pea | Rerie et al., Mol. Gen. Genet. 225: 148-157 (1991) |
| β-conglycinin β-subunit | soybean | WO 2004/071467 |
| BD30 (also called P34) | soybean | WO 2004/071467 |
| legumin A2 | pea | Rerie et al., Mol. Gen. Genet. 225: 148-157 (1991) |

TABLE 22

Transcription Terminators

| Transcription Terminator | Organism | Reference |
| --- | --- | --- |
| phaseolin 3' | bean | WO 2004/071467 |
| kunitz trypsin inhibitor 3' | soybean | WO 2004/071467 |
| BD30 (also called P34) 3' | soybean | WO 2004/071467 |
| legumin A2 3' | pea | WO 2004/071467 |
| albumin 2S 3' | soybean | WO 2004/071467 |

TABLE 23

PUFA Biosynthetic Pathway Genes

| Gene | Organism | Reference |
| --- | --- | --- |
| delta-6 desaturase | Saprolegnia diclina | WO 2002/081668 |
| delta-6 desaturase | Mortierella alpina | U.S. Pat. No. 5,968,809 |
| elongase | Mortierella alpina | WO 2000/12720 U.S. Pat. No. 6,403,349 |
| delta-5 desaturase | Mortierella alpina | U.S. Pat. No. 6,075,183 |
| delta-5 desaturase | Saprolegnia diclina | WO 2002/081668 |
| delta-5 desaturase | Peridinium sp. | U.S. Patent Application No. 11/748637 |

TABLE 23-continued

PUFA Biosynthetic Pathway Genes

| Gene | Organism | Reference |
| --- | --- | --- |
| delta-5 desaturase | Euglena gracilis | U.S. Patent Application No. 11/748629 |
| delta-15 desaturase | Fusarium moniliforme | WO 2005/047479 |
| delta-17 desaturase | Saprolegnia diclina | WO 2002/081668 |
| elongase | Thraustochytrium aureum | WO 2002/08401 U.S. Pat. No. 6,677,145 |
| elongase | Pavlova sp. | Pereira et al., Biochem. J. 384: 357-366 (2004) |
| delta-4 desaturase | Schizochytrium aggregatum | WO 2002/090493 U.S. Pat. No. 7,045,683 |
| delta-4 desaturase | Isochrysis galbana | WO 2002/090493 U.S. Pat. No. 7,045,683 |
| delta-4 desaturase | Thraustochytrium aureum | WO 2002/090493 U.S. Pat. No. 7,045,683 |
| delta-4 desaturase | Euglena gracilis | U.S. Patent Application No. 10/552,127 |
| delta-9 elongase | Isochrysis galbana | WO 2002/077213 |
| delta-9 elongase | Euglena gracilis | U.S. Patent Application No. 11/601,563 |
| delta-9 elongase | Eutreptiella sp. CCMP389 | U.S. Patent Application No. 11/601,564 |
| delta-9 elongase | Euglena anabaena | Pending |
| delta-8 desaturase | Euglena gracilis | WO 2000/34439 U.S. Pat. No. 6,825,017 WO 2004/057001 WO 2006/012325 |
| delta-8 desaturase | Acanthamoeba castellanii | Sayanova et al., FEBS Lett. 580: 1946-1952 (2006) |
| delta-8 desaturase | Pavlova salina | WO 2005/103253 |
| delta-8 desaturase | Pavlova lutheri | U.S. Patent Application No. 11/737772 |
| delta-8 desaturase | Tetruetreptia pomquetensis CCMP1491 | U.S. Patent Application No. 11/876115 |
| delta-8 desaturase | Eutreptiella sp. CCMP389 | U.S. Patent Application No. 11/876115 |
| delta-8 desaturase | Eutreptiella cf_gymnastica CCMP1594 | U.S. Patent Application No. 11/876115 |
| delta-8 desaturase | Euglena anabaena | Pending |

Example 25

Production and Model System Transformation of Somatic Soybean Embryo Cultures with Soybean Expression Vectors Culture Conditions:

Soybean embryogenic suspension cultures (cv. Jack) are maintained in 35 mL liquid medium SB196 (infra) on a rotary shaker, 150 rpm, 26° C. with cool white fluorescent lights on 16:8 hr day/night photoperiod at light intensity of 60-85 µE/m2/s. Cultures are subcultured every 7 days to two weeks by inoculating approximately 35 mg of tissue into 35 mL of fresh liquid SB196 (the preferred subculture interval is every 7 days).

Soybean embryogenic suspension cultures are transformed with the soybean expression plasmids by the method of particle gun bombardment (Klein et al., Nature 327:70 (1987)) using a DuPont Biolistic PDS1000/HE instrument (helium retrofit) for all transformations.

Soybean Embryogenic Suspension Culture Initiation:

Soybean cultures are initiated twice each month with 5-7 days between each initiation. Pods with immature seeds from available soybean plants are picked 45-55 days after planting. Seeds are removed from the pods and placed into a sterilized magenta box. The soybean seeds are sterilized by shaking them for 15 min in a 5% Clorox solution with 1 drop of Ivory soap (i.e., 95 mL of autoclaved distilled water plus 5 mL Clorox and 1 drop of soap, mixed well). Seeds are rinsed using 2 1-liter bottles of sterile distilled water and those less than 4 mm are placed on individual microscope slides. The small end of the seed is cut and the cotyledons are pressed out of the seed coat. When cultures are being prepared for production transformation, cotyledons are transferred to plates containing SB1 medium (25-30 cotyledons per plate). Plates are wrapped with fiber tape and are maintained at 26° C. with cool white fluorescent lights on 16:8 h day/night photoperiod at light intensity of 60-80 µE/m2/s for eight weeks, with a media change after 4 weeks. When cultures are being prepared for model system experiments, cotyledons are transferred to plates containing SB199 medium (25-30 cotyledons per plate) for 2 weeks, and then transferred to SB1 for 2-4 weeks. Light and temperature conditions are the same as described above. After incubation on SB1 medium, secondary embryos are cut and placed into SB196 liquid media for 7 days.

Preparation of DNA for Bombardment:

Either an intact plasmid or a DNA plasmid fragment containing the genes of interest and the selectable marker gene are used for bombardment. Fragments from soybean expression plasmids, the construction of which is described herein, are obtained by gel isolation of digested plasmids. In each case, 100 µg of plasmid DNA is used in 0.5 mL of the specific enzyme mix described below. Plasmids are digested with AscI (100 units) in NEBuffer 4 (20 mM Tris-acetate, 10 mM magnesium acetate, 50 mM potassium acetate, 1 mM dithiothreitol, pH 7.9), 100 µg/mL BSA, and 5 mM beta-mercaptoethanol at 37° C. for 1.5 hr. The resulting DNA fragments are separated by gel electrophoresis on 1% SeaPlaque GTG agarose (BioWhitaker Molecular Applications), and the DNA fragments containing gene cassettes are cut from the agarose gel. DNA is purified from the agarose using the GELase digesting enzyme following the manufacturer's protocol.

A 50 µL aliquot of sterile distilled water containing 3 mg of gold particles (3 mg gold) is added to 30 µL of a 10 ng/µL DNA solution (either intact plasmid or DNA fragment prepared as described herein), 25 µL 5M $CaCl_2$, and 20 µL of 0.1 M spermidine. The mixture is shaken 3 min on level 3 of a vortex shaker and spun for 10 sec in a bench microfuge. The supernatant is removed, followed by a wash with 400 µL 100% ethanol and another brief centrifugation. The 400 µl ethanol is removed, and the pellet is resuspended in 40 µL of 100% ethanol. Five µL of DNA suspension is dispensed to each flying disk of the Biolistic PDS1000/HE instrument disk. Each 5 µL aliquot contains approximately 0.375 mg gold per bombardment (e.g., per disk).

For model system transformations, the protocol is identical except for a few minor changes (i.e., 1 mg of gold particles is added to 5 µL of a 1 µg/µL DNA solution; 50 µL of a 2.5M $CaCl_2$ is used; and the pellet is ultimately resuspended in 85 µL of 100% ethanol thus providing 0.058 mg of gold particles per bombardment).

Tissue Preparation and Bombardment with DNA:

Approximately 150-200 mg of seven day old embryogenic suspension cultures is placed in an empty, sterile 60×15 mm petri dish, and the dish is covered with plastic mesh. The chamber is evacuated to a vacuum of 27-28 inches of mercury, and tissue is bombarded one or two shots per plate with membrane rupture pressure set at 1100 PSI. Tissue is placed approximately 3.5 inches from the retaining/stopping screen.

Model system transformation conditions are identical except 100-150 mg of embryogenic tissue is used; rupture pressure is set at 650 PSI; and tissue is placed approximately 2.5 inches from the retaining screen.

Selection of Transformed Embryos:

Transformed embryos are selected either using hygromycin (when the hygromycin B phosphotransferase (HPT) gene is used as the selectable marker) or chlorsulfuron (when the acetolactate synthase (ALS) gene is used as the selectable marker).

Following bombardment, the tissue is placed into fresh SB196 media and cultured as described above. Six to eight days post-bombardment, the SB196 is exchanged with fresh SB196 containing either 30 mg/L hygromycin or 100 ng/mL chlorsulfuron, depending on the selectable marker used. The selection media is refreshed weekly. Four to six weeks post-selection, green, transformed tissue is observed growing from untransformed, necrotic embryogenic clusters.

Embryo Maturation:

For production transformations, isolated, green tissue is removed and inoculated into multiwell plates to generate new, clonally propagated, transformed embryogenic suspension cultures. Transformed embryogenic clusters are cultured for four-six weeks in multiwell plates at 26° C. in SB196 under cool white fluorescent (Phillips cool white Econowatt F40/CW/RS/EW) and Agro (Phillips F40 Agro) bulbs (40 watt) on a 16:8 hr photoperiod with light intensity of 90-120 $\mu E/m^2 s$. After this time, embryo clusters are removed to a solid agar media, SB166, for one-two weeks and then subcultured to SB103 medium for 3-4 weeks to mature embryos. After maturation on plates in SB103, individual embryos are removed from the clusters, dried, and screened for alterations in their fatty acid compositions as described supra.

For model system transformations, embryos are matured in soybean histodifferentiation and maturation liquid medium (SHaM liquid media; Schmidt et al., *Cell Biology and Morphogenesis* 24:393 (2005)), using a modified procedure. Briefly, after 4 weeks of selection in SB196, as described above, embryo clusters are removed to 35 mL of SB228 (SHaM liquid media) in a 250 mL Erlenmeyer flask. Tissue is maintained in SHaM liquid media on a rotary shaker at 130 rpm and 26° C., with cool white fluorescent lights on a 16:8 hr day/night photoperiod at a light intensity of 60-85 µE/m2/s for 2 weeks as embryos matured. Embryos grown for 2 weeks in SHaM liquid media are equivalent in size and fatty acid content to embryos cultured on SB166/SB103 for 5-8 weeks.

After maturation in SHaM liquid media, individual embryos are removed from the clusters, dried, and screened for alterations in their fatty acid compositions as described supra.

Media Recipes:

SB 196—FN Lite Liquid Proliferation Medium (per liter)

| | |
|---|---|
| MS FeEDTA - 100x Stock 1 | 10 mL |
| MS Sulfate - 100x Stock 2 | 10 mL |
| FN Lite Halides - 100x Stock 3 | 10 mL |
| FN Lite P, B, Mo - 100x Stock 4 | 10 mL |
| B5 vitamins (1 mL/L) | 1.0 mL |
| 2,4-D (10 mg/L final concentration) | 1.0 mL |
| $KNO_3$ | 2.83 gm |
| $(NH_4)_2SO_4$ | 0.463 gm |
| asparagine | 1.0 gm |
| sucrose (1%) | 10 gm |
| pH 5.8 | |

FN Lite Stock Solutions

| Stock Number | | 1000 mL | 500 mL |
|---|---|---|---|
| 1 | MS Fe EDTA 100x Stock | | |
| | Na$_2$ EDTA* | 3.724 g | 1.862 g |
| | FeSO$_4$—7H$_2$O | 2.784 g | 1.392 g |
| 2 | MS Sulfate 100x stock | | |
| | MgSO$_4$—7H$_2$O | 37.0 g | 18.5 g |
| | MnSO$_4$—H$_2$O | 1.69 g | 0.845 g |
| | ZnSO$_4$—7H$_2$O | 0.86 g | 0.43 g |
| | CuSO$_4$—5H$_2$O | 0.0025 g | 0.00125 g |
| 3 | FN Lite Halides 100x Stock | | |
| | CaCl$_2$—2H$_2$O | 30.0 g | 15.0 g |
| | KI | 0.083 g | 0.0715 g |
| | CoCl$_2$—6H$_2$O | 0.0025 g | 0.00125 g |
| 4 | FN Lite P, B, Mo 100x Stock | | |
| | KH$_2$PO$_4$ | 18.5 g | 9.25 g |
| | H$_3$BO$_3$ | 0.62 g | 0.31 g |
| | Na$_2$MoO$_4$—2H$_2$O | 0.025 g | 0.0125 g |

*Add first, dissolve in dark bottle while stirring

SB1 Solid Medium (Per Liter)

1 package MS salts (Gibco/BRL—Cat. No. 11117-066)
1 mL B5 vitamins 1000× stock
31.5 g glucose
2 mL 2,4-D (20 mg/L final concentration)
pH 5.7
8 g TC agar

SB199 Solid Medium (Per Liter)

1 package MS salts (Gibco/BRL—Cat. No. 11117-066)
1 mL B5 vitamins 1000× stock
30 g Sucrose
4 ml 2,4-D (40 mg/L final concentration)
pH 7.0
2 gm Gelrite

SB 166 Solid Medium (Per Liter)

1 package MS salts (Gibco/BRL—Cat. No. 11117-066)
1 mL B5 vitamins 1000× stock
60 g maltose
750 mg MgCl$_2$ hexahydrate
5 g activated charcoal
pH 5.7
2 g gelrite

SB 103 Solid Medium (per liter)

1 package MS salts (Gibco/BRL—Cat. No. 11117-066)
1 mL B5 vitamins 1000× stock
60 g maltose
750 mg MgCl$_2$ hexahydrate
pH 5.7
2 g gelrite

SB 71-4 Solid Medium (Per Liter)

1 bottle Gamborg's B5 salts w/ sucrose (Gibco/BRL—Cat. No. 21153-036)
pH 5.7
5 g TC agar

2,4-D Stock

Obtain premade from Phytotech Cat. No. D 295—concentration 1 mg/mL

B5 Vitamins Stock (Per 100 mL)

Store aliquots at −20° C.

10 g myo-inositol 100 mg nicotinic acid 100 mg pyridoxine HCl 1 g thiamine

If the solution does not dissolve quickly enough, apply a low level of heat via the hot stir plate.

SB 228—Soybean Histodifferentiation & Maturation (Sham) (Per Liter)

| | |
|---|---|
| DDI H$_2$O | 600 mL |
| FN-Lite Macro Salts for SHaM 10X | 100 mL |
| MS Micro Salts 1000x | 1 mL |
| MS FeEDTA 100x | 10 mL |
| CaCl 100x | 6.82 mL |
| B5 Vitamins 1000x | 1 mL |
| L-Methionine | 0.149 g |
| Sucrose | 30 g |
| Sorbitol | 30 g |
| Adjust volume to 900 mL | |
| pH 5.8 | |
| Autoclave | |
| Add to cooled media (≤30° C.): | |
| *Glutamine (final concentration 30 mM) 4% | 110 mL |

*Note: Final volume will be 1010 mL after glutamine addition.
Since glutamine degrades relatively rapidly, it may be preferable to add immediately prior to using media. Expiration 2 weeks after glutamine is added; base media can be kept longer without glutamine.

FN-lite Macro for SHAM 10×—Stock #1 (Per Liter)

| | |
|---|---|
| (NH$_4$)$_2$SO$_4$ (ammonium sulfate) | 4.63 g |
| KNO$_3$ (potassium nitrate) | 28.3 g |
| MgSO$_4$*7H$_2$0 (magnesium sulfate heptahydrate) | 3.7 g |
| KH$_2$PO$_4$ (potassium phosphate, monobasic) | 1.85 g |
| Bring to volume | |
| Autoclave | |

MS Micro 1000×—Stock #2 (Per 1 Liter)

| | |
|---|---|
| H$_3$BO$_3$ (boric acid) | 6.2 g |
| MnSO$_4$*H$_2$O (manganese sulfate monohydrate) | 16.9 g |
| ZnSO4*7H$_2$0 (zinc sulfate heptahydrate) | 8.6 g |
| Na$_2$MoO$_4$*2H$_2$0 (sodium molybdate dihydrate) | 0.25 g |
| CuSO$_4$*5H$_2$O (copper sulfate pentahydrate) | 0.025 g |
| CoCl$_2$*6H$_2$0 (cobalt chloride hexahydrate) | 0.025 g |
| KI (potassium iodide) | 0.8300 g |
| Bring to volume | |
| Autoclave | |

FeEDTA 1000×—Stock #3 (Per Liter)

| | |
|---|---|
| Na₂EDTA* (sodium EDTA) | 3.73 g |
| FeSO₄*7H₂0 (iron sulfate heptahydrate) | 2.78 g |

*EDTA must be completely dissolved before adding iron.
Bring to Volume
Solution is photosensitive. Bottle(s) should be wrapped in foil to omit light.
Autoclave Ca 1000×—Stock #4 (Per Liter)

| | |
|---|---|
| CaCl₂*2H₂0 (calcium chloride dihydrate) | 44 g |
| Bring to Volume | |
| Autoclave | |

B5 Vitamin 1000×—Stock #5 (Per Liter)

| | |
|---|---|
| Thiamine*HCl | 10 g |
| Nicotinic Acid | 1 g |
| Pyridoxine*HCl | 1 g |
| Myo-Inositol | 100 g |
| Bring to Volume | |
| Store frozen | |

4% Glutamine—Stock #6 (Per Liter)

| | |
|---|---|
| DDI water heated to 30° C. | 900 mL |
| L-Glutamine | 40 g |
| Gradually add while stirring and applying low heat. | |
| Do not exceed 35° C. | |
| Bring to Volume | |
| Filter Sterilize | |
| Store frozen* | |

*Note: Warm thawed stock in 31° C. bath to fully dissolve crystals.

Example 26

Chlorsulfuron Selection (ALS) and Plant Regeneration

Chlorsulfuron (ALS) Selection:

Following bombardment, the tissue is divided between 2 flasks with fresh SB196 media and cultured as described in Example 25. Six to seven days post-bombardment, the SB196 is exchanged with fresh SB196 containing selection agent of 100 ng/mL chlorsulfuron (chlorsulfuron stock is 1 mg/mL in 0.01 N ammonium hydroxide). The selection media is refreshed weekly. Four to six weeks post selection, green, transformed tissue may be observed growing from untransformed, necrotic embryogenic clusters. Isolated, green tissue is removed and inoculated into multiwell plates containing SB196, and embryos are matured as described in Example 25.

Regeneration of Soybean Somatic Embryos into Plants:

In order to obtain whole plants from embryogenic suspension cultures, the tissue must be regenerated. Embryos are matured as described in Example 25. After subculturing on medium SB103 for 3 weeks, individual embryos can be removed from the clusters and screened for alterations in their fatty acid compositions as described herein. It should be noted that any detectable phenotype, resulting from the expression of the genes of interest, could be screened at this stage. This would include, but not be limited to, alterations in fatty acid profile, protein profile and content, carbohydrate content, growth rate, viability, or the ability to develop normally into a soybean plant.

Matured individual embryos are desiccated by placing them into an empty, small petri dish (35×10 mm) for approximately 4 to 7 days. The plates are sealed with fiber tape (creating a small humidity chamber). Desiccated embryos are planted into SB71-4 medium where they are left to germinate under the same culture conditions described above. Germinated plantlets are removed from germination medium and rinsed thoroughly with water and then are planted in Redi-Earth in 24-cell pack tray, covered with clear plastic dome. After 2 weeks the dome is removed, and plants are hardened off for a further week. If plantlets look hardy, they are transplanted to 10" pot of Redi-Earth with up to 3 plantlets per pot. After 10 to 16 weeks, mature seeds are harvested, chipped, and analyzed for fatty acids.

Example 27

Functional Analysis of the *Euglena gracilis* and *Euglena anabaena* DHA Synthases in *Yarrowia lipolytica*

Each of the expression vectors described below in Table 24 was transformed into *Yarrowia lipolytica* strain Y2224 (a uracil ura3 auxotrophic strain of *Yarrowia lipolytica*) as described in the General Methods above.

Single colonies of transformant *Yarrowia lipolytica* containing an appropriate *Yarrowia* expression vector (see Table 24) were grown in 3 mL MM lacking uracil supplemented with 0.2% tergitol at 30° C. for 1 day. After this, 0.05 mL was transferred to 3 mL of the same medium supplemented with either no fatty acid or EPA to 0.175 mM. These were incubated for 16 hr at 30° C., 250 rpm and then pellets were obtained by centrifugation. Cells were washed once with water, pelleted by centrifugation and air dried. Pellets were transesterified (Roughan, G. and Nishida, I., *Arch. Biochem. Biophys.* 276(1):38-46 (1990)) with 500 µL of 1% sodium methoxide for 30 min at 50° C. after which 500 µL of 1 M sodium chloride and 100 µL of heptane were added. After thorough mixing and centrifugation, fatty acid methyl esters (FAMEs) were analyzed by GC as described supra (see General Methods).

TABLE 24

Summary of Vectors Transformed Into *Yarrowia lipolytica*

| Vector | Vector Backbone | Gene Expressed (SEQ ID NO:) | Ex. No. | FIG. No. | SEQ ID NO: | Comments |
|---|---|---|---|---|---|---|
| pBY-EgC20elo1 | pBY1 | EgC20elo1 (SEQ ID NO: 5) | 9 | 7D | 39 | EgC20elo1 expressed as fusion protein |

TABLE 24-continued

Summary of Vectors Transformed Into *Yarrowia lipolytica*

| Vector | Vector Backbone | Gene Expressed (SEQ ID NO:) | Ex. No. | FIG. No. | SEQ ID NO: | Comments |
|---|---|---|---|---|---|---|
| pY132 | pBY1 | EgDHAsyn1 (SEQ ID NO: 11) | 9 | 8A | 40 | EgDHAsyn1 expressed as fusion protein |
| pY161 | pY159 | EgDHAsyn1 (SEQ ID NO: 11) | 9 | 8B | 41 | EgDHAsyn1 expressed from gene's translational start site |
| pY164 | pY159 | EgDHAsyn2 (SEQ ID NO: 21) | 9 | 8C | 42 | EgDHAsyn2 expressed from gene's translational start site |
| pY141 | pY115 | EgDHAsyn1* (SEQ ID NO: 205) | 10 | 8D | 49 | Internal NcoI site of EgDHAsyn1 was removed to yield EgDHAsyn1*; no further nucleotide changes made |
| pY165 | pY159 | EaDHAsyn1 (SEQ ID NO: 91) | 14 | 14A | 99 | EaDHAsyn1 expressed from gene's translational start site |
| pY166 | pY159 | EaDHAsyn2 (SEQ ID NO: 92) | 14 | 14B | 100 | EaDHAsyn2 expressed from gene's translational start site |
| pY167 | pY159 | EaDHAsyn3 (SEQ ID NO: 93) | 14 | 14C | 101 | EaDHAsyn3 expressed from gene's translational start site |
| pY168 | pY159 | EaDHAsyn4 (SEQ ID NO: 94) | 14 | 14D | 102 | EaDHAsyn4 expressed from gene's translational start site |

The fatty acid profile for *Yarrowia* expressing pBY-EgC20elo1 showed no elongation of EPA to DPA. The fatty acid profiles, calculated % elongation and calculated % desaturation for the remaining clones are shown in FIG. 18. Percent C20 elongation (% C20 Elong) was calculated by dividing the sum of the weight percent (wt. %) for DPA and DHA by the sum of the wt. % for EPA, DPA and DHA and multiplying by 100 to express as a %. Similarly, percent delta-4 desaturation (% D4 Desat) was calculated by dividing the wt. % for DHA by the sum of the wt. % for DPA and DHA and multiplying by 100 to express as a %. Averages are indicated by Ave. followed by appropriate header.

In summary of FIG. 18, all of the DHA synthases except for EaDHAsyn4 functioned as both C20 elongases (elongating EPA to DPA) and as delta-4 desaturases (desaturating DPA to DHA) in *Yarrowia*. EaDHAsyn4, which contained a substantially different amino acid sequence at the C-terminus due to a frameshift in the nucleotide sequence, had considerably lower elongation function and no desaturase activity was detected. Expressing EgDHAsyn1 in pY132 consistently resulted in higher activity in *Yarrowia* when compared to the other EgDHAsyn1 constructs, likely due to the fact that EgDHAsyn1 was expressed as an in-frame fusion between some vector sequence, the 5' UTR of EgDHAsyn1 and the EgDHAsyn1 coding sequence. The resulting fusion created may lead to enhanced activity because of enhanced expression in *Yarrowia* or because of an inherent increase in activity to the enzyme itself. When only the coding sequence of EgDHAsyn1* is expressed (i.e., with no 5'UTR; see pY141), the activity is higher than when the 5'UTR is present but not translated as a fusion (i.e., see pY161). This observation is likely due to a decrease in expression of EgDHAsyn1 due to the presence of the 5'UTR.

Example 28

Functional Analysis of EqDHAsvn1 Independent C20 Elongase and Delta-4 Desaturase Domains and Comparison with Heterologous Fusions Each of the expression vectors described below in Table 25 (and a vector only control) was transformed into *Yarrowia lipolytica* strain Y2224, as described in Example 27. EPA and/or DPA was fed to the transformed *Yarrowia* cells. A schematic showing the relative domain structure for each construct in Table 25 is shown in FIG. 21.

TABLE 25

Summary of Vectors Expressed in *Yarrowia lipolytica*

| Vector | Gene Expressed (SEQ ID NO:) | Ex. No. | FIG. No. | SEQ ID NO: | Comments |
|---|---|---|---|---|---|
| pY141 | EgDHAsyn1* (SEQ ID NO: 205) | 10 | 8D | 49 | internal NcoI site of EgDHAsyn1 was removed to yield EgDHAsyn1*; no further nucleotide changes made |

TABLE 25-continued

Summary of Vectors Expressed in *Yarrowia lipolytica*

| Vector | Gene Expressed (SEQ ID NO:) | Ex. No. | FIG. No. | SEQ ID NO: | Comments |
|---|---|---|---|---|---|
| pY143 | EgDHAsyn1C20EloDom1 (SEQ ID NO: 206) | 10 | 9A | 52 | contains the N-terminal domain of EgDHAsyn1* (EgDHAsyn1C20EloDom1) and does not include the proline-rich linker or delta-4 desaturase domain |
| pY149 | EgDHAsyn1C20EloDom2Linker (SEQ ID NO: 207) | 10 | 9B | 55 | contains the N-terminal domain of EgDHAsyn1* as well as the proline-rich linker, but does not contain the delta-4 desaturase domain; also contains 4 additional amino acids (i.e., SCRT) after the linker region |
| pY150 | IgD4* (SEQ ID NO: 210) | 11 | 9C | 62 | *Isochrysis galbana* delta-4 desaturase with SbfI site at the 5' end after the start codon |
| pY156 | EgDHAsyn1C20EloDom3-IgD4 ("IgFus") (SEQ ID NO: 211) | 11 | 9D | 64 | contains in-frame fusion between the EgDHAsyn1C20EloDom3Linker and IgD4*, separated by the proline-rich linker region |
| pY152 | EgDHAsyn1D4Dom1 ("EgD4Dom1") (SEQ ID NO: 216) | 11 | 10A | 67 | contains the C-terminal domain of EgDHAsyn1* (i.e., the delta-4 desaturase domain, starting just after the end of the proline-rich linker region); also contains an ATG start codon at the 5' end of the PCR product followed by an SbfI site |
| pY157 | EgDHAsyn1C20EloDom3-EgD4Dom1 ("EgFus") (SEQ ID NO: 218) | 11 | 10B | 69 | contains an in-frame fusion between EgDHAsyn1C20EloDom and EgDHAsyn1D4Dom1, separated by the proline-rich linker region (called EgDHAsyn1C20EloDom3-EgD4Dom1); almost identical to EgDHAsyn1 except one amino acid (i.e., G323L) is changed due to the SbfI cloning site and fusion junction |
| pY153 | EgDHAsyn1D4Dom2 (SEQ ID NO: 220) "EgD4Dom2" | 11 | 10C | 72 | contains region of the C-terminus of EgDHAsyn1 containing the delta-4 desaturase domain and some of the C20 elongase domain |
| pY151 | SaD4* (SEQ ID NO: 223) | 11 | 10D | 76 | *Schizochytrium aggregatum* delta-4 desaturase with SbfI site at the 5' end after the start codon |
| pY160 | EgDHAsyn1C20EloDom3-SaD4 ("SaFus") (SEQ ID NO: 225) | 11 | 11 | 77 | contains in-frame fusion between EgDHAsyn1C20EloDom3 and SaD4, separated by the proline-rich linker region |

Fatty acid profiles of the transformant cells were subsequently analyzed as described in Example 27.

The results for feeding EPA to a vector only control, pY141, pY143, pY149, pY156, pY157 and pY160 are shown in FIG. 19. The fatty acid profiles for *Yarrowia* expressing pY150, pY151, pY152 and pY153 showed no elongation of EPA to DPA and are not shown in FIG. 19.

The results for feeding DPA to a vector only control, pY141, pY150, pY151, pY152, pY153, pY156, pY157 and pY160 are shown in FIG. 20. The fatty acid profiles for *Yarrowia* expressing pY143 and pY149 showed no desaturation of DPA to DHA and are not shown in FIG. 20.

Percent C20 elongation (% C20 Elong), percent delta-4 desaturation (% D4 Desat) and averages were calculated as described in Example 27.

In summary of FIG. 19 and FIG. 20, when the EgDHAsyn1C20Elo domain is expressed alone (with or without the linker; i.e., pY143 and pY149), the average percent C20 elongation increases by about 40% compared to the native EgDHAsyn1*(pY141; SEQ ID NO:49). The opposite occurs with the EgDHAsyn1 delta-4 desaturase domain where there is no activity with EgDHAsyn1 D4Dom1 (pY152; SEQ ID NO:67; see FIG. 20) and about 50% less with EgDHAsyn1 D4Dom2 (pY153; SEQ ID NO:72; see FIG. 20) when expressed alone compared to EgDHAsyn1*

(pY141; SEQ ID NO:49; see FIG. 20) fed DPA. The IgD4 has no delta-4 desaturase activity when expressed alone (pY150; SEQ ID NO:62; see FIG. 20) or as a fusion (pY156; SEQ ID NO:64; see FIGS. 19 and 20) and even causes an approximately 50% decrease in elongation activity when fused to the EgDHAsyn1C20 elongase domain (pY156; SEQ ID NO:64; see FIG. 19), possibly due to incorrect folding. In contrast, the SaD4 expressed alone (pY151; SEQ ID NO:76; see FIG. 20) has approximately the same delta-4 desaturase activity as that for the native EgDHAsyn1*(pY141; SEQ ID NO:49; see FIG. 20). Interestingly, the delta-4 desaturase activity of SaD4 increases approximately 2-fold when fused to the EgDHAsyn1 C20 elongase domain (pY160; SEQ ID NO:77; see FIG. 20). When fused to EgDHAsyn1 C20 elongase domain and fed EPA (pY160; SEQ ID NO:77; see FIG. 19), the delta-4 desaturase activity is approximately 3-fold higher than when DPA is fed (pY160; SEQ ID NO:77; see FIG. 20) suggesting the linking of the two domains results in increased efficiency or flux, perhaps due to substrate channeling.

Example 29

Substrate Specificity of EgDHAsyn1

GLA, STA, EDA, ERA, DGLA, ETA, ARA, EPA and DPA were fed to *Yarrowia* cells transformed with pY141 (EgDHAsyn1*; SEQ ID NO:49) and a vector only control and fatty acid profiles were analyzed as described in Example 27.

The results for feeding EPA, ARA and DPA are shown in FIG. 22. The fatty acid profiles for *Yarrowia* fed with GLA, STA, EDA, ERA, DGLA and ETA showed no elongation and are not shown in FIG. 22. Percent C20 elongation (% C20 Elong) and percent delta-4 desaturation (% D4 Desat) and averages were calculated as described in Example 27 when fed EPA or DPA. When fed ARA, percent C20 elongation (% C20 Elong) was calculated by dividing the sum of the wt. % for docosatetraenoic acid [DTA; 22:4 (7,10,13,16)] and omega-6 docosapentaenoic acid [DPAn-6; 22:5(4,7,10,13,16)] by the sum of the wt. % for ARA, DTA and DPAn-6 and multiplying by 100 to express as a %. Similarly, percent delta-4 desaturation (% D4 Desat) when fed ARA was calculated by dividing the wt. % for DPAn-6 by the sum of the wt. % for DTA and DPAn-6 and multiplying by 100 to express as a %.

In summary of FIG. 22, EgDHAsyn1* elongates both ARA and EPA although it has a slight preference (approximately 40% more active) for EPA. The elongation product of ARA (i.e., DTA) is also desaturated in the delta-4 position by EgDHAsyn1 to produce DPAn-6 and the activity is approximately 40% higher for DTA than DPA.

Example 30

Co-expression of the *Euglena gracilis* DHA Synthase 1 with the *Pavlova lutheri* Delta-8 Desaturase, the *Mortierella alpina* Delta-5 Desaturase, the *Saprolegnia diclina* Delta-17 Desaturase and the *Euglena gracilis* Delta-9 Elongase in Soybean Embryos Transformed with Soybean Expression Vectors pKR973 and pKR1064

Mature somatic soybean embryos are a good model for zygotic embryos. While in the globular embryo state in liquid culture, somatic soybean embryos contain very low amounts of triacylglycerol or storage proteins typical of maturing, zygotic soybean embryos. At this developmental stage, the ratio of total triacylglyceride to total polar lipid (phospholipids and glycolipid) is about 1:4, as is typical of zygotic soybean embryos at the developmental stage from which the somatic embryo culture was initiated. At the globular stage as well, the mRNAs for the prominent seed proteins, α'-subunit of β-conglycinin, kunitz trypsin inhibitor 3, and seed lectin are essentially absent. Upon transfer to hormone-free media to allow differentiation to the maturing somatic embryo state, triacylglycerol becomes the most abundant lipid class. As well, mRNAs for α'-subunit of β-conglycinin, kunitz trypsin inhibitor 3 and seed lectin become very abundant messages in the total mRNA population. On this basis, the somatic soybean embryo system behaves very similarly to maturing zygotic soybean embryos in vivo, and is thus a good and rapid model system for analyzing the phenotypic effects of modifying the expression of genes in the fatty acid biosynthesis pathway (see PCT Publication No. WO 2002/00904, Example 3). Most importantly, the model system is also predictive of the fatty acid composition of seeds from plants derived from transgenic embryos.

Fatty Acid Analysis of Transgenic Somatic Soybean Embryos Expressing pKR973 and pKR1064:

Soybean embryogenic suspension cultures (cv. Jack) were transformed with the AscI fragments of pKR973 and pKR1064 (fragments containing the expression cassettes), as described for production in Example 25 and as summarized in Table 26.

TABLE 26

Summary of Vectors Expressed in Soybean

| Vector | Ex. No. | FIG. No. | SEQ ID NO: | Genes Expressed |
|---|---|---|---|---|
| pKR973 | 16 | 15B | 128 | *Pavlova lutheri* delta-8 desaturase, *Mortierella alpina* delta-5 desaturase and *Euglena gracilis* delta-9 elongase |
| pKR1064 | 17 | 15C | 132 | *Euglena gracilis* DHA synthase 1 and *Saprolegnia diclina* delta-17 desaturase |

A subset of soybean embryos generated from each event (ten embryos per event) were harvested and picked into glass GC vials and fatty acid methyl esters were prepared by transesterification. For transesterification, 50 µL of trimethylsulfonium hydroxide (TMSH) and 0.5 mL of hexane were added to the embryos in glass vials and incubated for 30 min at room temperature while shaking. Fatty acid methyl esters (5 µL injected from hexane layer) were separated and quantified using a Hewlett-Packard 6890 Gas Chromatograph fitted with an Omegawax 320 fused silica capillary column (Cat. No. 24152, Supelco Inc.). The oven temperature was programmed to hold at 220° C. for 2.6 min, increase to 240° C. at 20° C./min and then hold for an additional 2.4 min. Carrier gas was supplied by a Whatman hydrogen generator. Retention times were compared to those for methyl esters of standards commercially available (Nu-Chek Prep, Inc.). Events having good phenotype were re-analyzed by GC using identical conditions except the oven temperature held at 150° C. for 1 min and then increased to 240° C. at 5° C.

The fatty acid profiles for individual embryos from a representative event are shown in FIG. 23. Fatty acids are identified as 16:0 (palmitate), 18:0 (stearic acid), 18:1 (oleic acid), 18:2 (LA), GLA, 18:3 (ALA), EDA, DGLA, ARA, ERA, JUN, EPA, 22:3 (10,13,16) (docosatrienoic acid), DTA, DPA and DHA; and, fatty acid compositions listed in FIG. 23 are expressed as a weight percent (wt. %) of total fatty acids.

The activity of EgDHAsyn1 is expressed as percent C20 elongation (% C20 Elong) and/or percent delta-4 desaturation (% D4 Desat), calculated according to the following formula: ([product]/[substrate+product])*100.

More specifically, the percent elongation for EPA is shown as % C20 Elong, determined as: ([DPA+DHA]/[EPA+DPA+DHA])*100. The percent delta-4 desaturation for DPA is shown as % D4 Desat, determined as ([DHA]/[DPA+DHA])*100. Other fatty acids that may be elongated or desaturated were not included in this calculation.

In addition to elongation and desaturation products for EPA and ARA, it appears that in soybean, DGLA is also elongated by the EgDHAsyn1 as a significant amount of the fatty acid 22:3 (10,13,16) was made. The fatty acid was identified as 22:3 (10,13,16) because it was found to have a mass for 22:3 by GC-MS and had an MS profile that agrees with that for 22:3 (10,13,16).

Example 31

Expression of the *Euglena gracilis* Delta-9 Elongase/*Pavlova lutheri* Delta-8 Desaturase Fusion (EqD9elo-EqDHAsvn1 Link-PavD8) in Soybean Embryos Transformed With Soybean Expression Vectors KS373

Soybean embryogenic suspension culture (cv. Jack) was transformed with KS373 (SEQ ID NO:179; FIG. 17) and KS120 (which is described in PCT Publication No. WO 2004/071467 and the contents of which are hereby incorporated by reference) as described for the model system in Example 25. KS120 contains the hygromycin selection. KS373, produced in Example 23, enabled expression of a fusion protein comprising the *Euglena gracilis* delta-9 elongase and the *Pavlova lutheri* delta-8 desaturase, wherein the two domains were linked with *Euglena gracilis* DHA Synthase 1 Linker (i.e., EgDHAsyn1 Link).

The fatty acid profiles for five individual embryos from 31 events were obtained as described in Example 30. Results from the five best elongation events are shown in FIG. 24. Fatty acids are identified as 16:0 (palmitate), 18:0 (stearic acid), 18:1 (oleic acid), 18:2 (LA), GLA, 18:3 (ALA), EDA, DGLA, ERA and ETA; and, fatty acid compositions listed in FIG. 24 are expressed as a weight percent (wt. %) of total fatty acids.

The activity of EgD9elo-EgDHAsyn1 Link-PavD8 is expressed as percent delta-9 elongation (% D9 Elong) and/or percent delta-8 desaturation (% D8 Desat), calculated according to the following formula: ([product]/[substrate+product])*100.

More specifically, the percent delta-9 elongation is shown as % D9 Elong, determined as: ([EDA+ERA+DGLA+ETA]/[LA+ALA+EDA+ERA+DGLA+ETA])*100. The percent delta-8 desaturation is shown as % D8 Desat, determined as ([DGLA+ETA]/[EDA+ERA+DGLA+ETA])*100.

The best % D9 Elong event had an average elongation of 22.1% with an average % D8 Desat of 92.7%. Elongation is slightly lower than that seen when the delta-9 elongase is expressed alone in soybean embryos although this might be due to the small numbers of events looked at. In contrast, desaturation is considerably higher when the PavD8 is fused with the EgD9elo and EgDHAsyn1 Link than when the PavD8 is expressed alone in soybean embryos, reaching almost 100% conversion in some events. This enhanced conversion by the delta-8 desaturase might be due to increased efficiency or flux, perhaps due to substrate channeling.

Example 32

Synthesis And Functional Analysis of a Codon-Optimized C20 Elongase Gene (EqC20ES), From *Euglena gracilis* in *Yarrowia lipolytica*

The codon usage of the C20 elongase domain of EgDHAsyn1 (EgDHAsyn1C20EloDom1) of *Euglena gracilis* (i.e., corresponding to amino acids 1-303 of SEQ ID NO:12) was optimized for expression in *Yarrowia lipolytica*, in a manner similar to that described in PCT Publication No. WO 2004/101753 and U.S. Pat. No. 7,125,672. Specifically, a codon-optimized C20 elongase gene (designated "EgC20ES" and having the nucleotide sequence as set forth in SEQ ID NO:183 and the amino acid sequence as set forth in SEQ ID NO:184) was designed, based on the coding sequence of the C20 elongase domain of EgDHAsyn1 (SEQ ID NO:201), according to the *Yarrowia* codon usage pattern (PCT Publication No. WO 2004/101753), the consensus sequence around the 'ATG' translation initiation codon, and the general rules of RNA stability (Guhaniyogi, G. and J. Brewer, Gene, 265 (1-2):11-23 (2001)). In addition to the modification of the translation initiation site, 163 bp of the 909 bp coding region were modified (17.9%) and 147 codons were optimized (48.5%). None of the modifications in the codon-optimized gene changed the amino acid sequence of the encoded protein (i.e., SEQ ID NO:184 is 100% identical in sequence to amino acids 1-303 of SEQ ID NO:12). The designed EgC20ES gene (SEQ ID NO:183) was synthesized by GenScript Corporation (Piscataway, N.J.) and cloned into pUC57 (GenBank Accession No. Y14837) to generate pEgC20ES (FIG. 51B; SEQ ID NO:185).

To analyze the function of the codon-optimized EgC20ES gene, plasmid pZuFmEgC20ES (FIG. 52A; SEQ ID NO:360) comprising a chimeric FBAINm::EgC20ES::Pex20 gene was constructed. Plasmid pZuFmEgC20ES contained the following components:

TABLE 27

| Components Of Plasmid pZuFmEgC20ES (SEQ ID NO: 360) | |
|---|---|
| RE Sites And Nucleotides Within SEQ ID NO: 360 | Description Of Fragment And Chimeric Gene Components |
| SwaI/BsiWI (6063-318) | FBAINm::EgC20ES::Pex20, comprising: FBAINm: *Yarrowia lipolytica* FBAINm promoter (PCT Publication No. WO 2005/049805; U.S. Pat. No. 7,202,356); EgC20ES: codon-optimized C20 elongase gene (SEQ ID NO: 183), derived from *Euglena gracilis*; Pex20: Pex20 terminator sequence of *Yarrowia* Pex20 gene (GenBank Accession No. AF054613) |
| 2269-1389 | ColE1 plasmid origin of replication |
| 3199-2339 | Ampicillin-resistance gene (Amp$^R$) for selection in *E. coli* |
| 4098-5402 | *Yarrowia* autonomous replication sequence (ARS18; GenBank Accession No. A17608) |
| 6935-5448 | *Yarrowia* Ura 3 gene (GenBank Accession No. AJ306421) |

Plasmid pZuFmEgC20ES was transformed into *Yarrowia lipolytica* strain Y4184U4, as described in the General Methods. The transformants were selected on MM plates. After 2 days growth at 30° C., 10 transformants grown on the MM plates were picked and re-streaked onto fresh MM plates.

Once grown, 10 strains were individually inoculated into 3 mL liquid MM at 30° C. and shaken at 250 rpm/min for 2 days. The cells were collected by centrifugation; lipids were extracted; and fatty acid methyl esters were prepared by trans-esterification and subsequently analyzed with a Hewlett-Packard 6890 GC.

GC analyses showed that there were about 6.2% EPA and 2.8% DPA of total lipids produced in all ten transformants, wherein the conversion efficiency of EPA to DPA in these 10 strains was determined to be about 31% (calculated as described in Example 27). Thus, this experimental data demonstrated that the synthetic *Euglena gracilis* C20 elongase codon-optimized for expression in *Yarrowia lipolytica* (i.e., EgC20ES, as set forth in SEQ ID NO:183) actively converts EPA to DPA.

Example 33

Synthesis and Functional Analysis of a
Codon-Optimized C20 Elongase Gene (EaC20ES)
From *Euglena anabaena* in *Yarrowia lipolytica*

The codon usage of the C20 elongase domain of EaDHAsyn2 (SEQ ID NO:228) of *Euglena anabaena* (i.e., corresponding to amino acids 1-299 of SEQ ID NO:96) was optimized for expression in *Yarrowia lipolytica*, in a manner similar to that described in PCT Publication No. WO 2004/101753, U.S. Pat. No. 7,125,672 and above in Example 32. Specifically, a codon-optimized C20 elongase gene (designated "EaC20ES" and having the nucleotide sequence as set forth in SEQ ID NO:188 and the amino acid sequence as set forth in SEQ ID NO:189) was designed, based on the coding sequence of the C20 elongase domain of EaDHAsyn2 (SEQ ID NO:92), according to the *Yarrowia* codon usage pattern (PCT Publication No. WO 2004/101753), the consensus sequence around the 'ATG' translation initiation codon, and the general rules of RNA stability (Guhaniyogi, G. and J. Brewer, *Gene*, 265(1-2):11-23 (2001)). In addition to the modification of the translation initiation site, 143 bp of the 897 bp coding region were modified (15.9%) and 134 codons were optimized (44.8%). None of the modifications in the codon-optimized gene changed the amino acid sequence of the encoded protein (i.e., SEQ ID NO:189 is 100% identical in sequence to amino acids 1-299 of SEQ ID NO:96). The designed EaC20ES gene (SEQ ID NO:188) was synthesized by GenScript Corporation (Piscataway, N.J.) and was cloned into pUC57 (GenBank Accession No. Y14837) to generate pEaC20ES (SEQ ID NO:190).

To analyze the function of the codon-optimized EaC20ES gene, plasmid pZuFmEaC20ES (SEQ ID NO:361) was constructed comprising a chimeric FBAINm::EaC20ES::Pex20 gene. Plasmid pZuFmEaC20ES (SEQ ID NO: 361) was identical in construction to that of plasmid pZuFmEgC20ES (SEQ ID NO:360; FIG. 52A), with the exception that EaC20ES (SEQ ID NO:188) was used in place of EgC20ES (SEQ ID NO:183).

Plasmid pZuFmEaC20ES (SEQ ID NO:361) was transformed into *Yarrowia lipolytica* strain Y4184U4, as described in the General Methods. The transformants were selected on MM plates. After 2 days growth at 30° C., 20 transformants grown on the MM plates were picked and re-streaked onto fresh MM plates. Once grown, 20 strains were individually inoculated into 3 mL liquid MM at 30° C. and shaken at 250 rpm/min for 2 days. The cells were collected by centrifugation; lipids were extracted; and fatty acid methyl esters were prepared by trans-esterification and subsequently analyzed with a Hewlett-Packard 6890 GC.

GC analyses showed that there were about 7.4% EPA and 1% DPA of total lipids produced in all 20 transformants, wherein the conversion efficiency of EPA to DPA in these 20 strains was determined to be about 11% (calculated as described in Example 27). Thus, this experimental data demonstrated that the synthetic *Euglena anabaena* C20 elongase codon-optimized for expression in *Yarrowia lipolytica* (i.e., EaC20ES, as set forth in SEQ ID NO:188) actively converts EPA to DPA.

Example 34

Synthesis and Functional Analysis of a
Codon-Optimized Delta-4 Desaturase Gene (EaD4S)
From *Euglena anabaena* in *Yarrowia lipolytica*

The codon usage of the delta-4 desaturase domain of EaDHAsyn2 (SEQ ID NO:243) of *Euglena anabaena* (i.e., corresponding to amino acids 259-841 of SEQ ID NO:96) was optimized for expression in *Yarrowia lipolytica*, in a manner similar to that described in PCT Publication No. WO 2004/101753, U.S. Pat. No. 7,125,672 and above in Examples 32 and 33. Specifically, a codon-optimized delta-4 desaturase gene (designated "EaD4S" and having the nucleotide sequence as set forth in SEQ ID NO:192 and the amino acid sequence as set forth in SEQ ID NO:193) was designed, based on the coding sequence of the delta-4 desaturase domain of EaDHAsyn2 (SEQ ID NO:92), which is also provided as SEQ ID NO:194 (nucleotide) and SEQ ID NO:195 (amino acid). In addition to the modification of the translation initiation site, 307 bp of the 1752 (including the TAA stop codon) bp coding region were modified (17.5%) and 285 codons were optimized (48.8%). Additionally, a NcoI site was introduced around the translation start codon by changing the second amino acid of the wild type delta-4 desaturase domain (i.e., amino acid residue 260 of SEQ ID NO:96 or amino acid residue 2 of SEQ ID NO:195) from a leucine to a valine residue in the synthetic EaD4S gene; thus, the amino acid sequence of EaD4S is set forth in SEQ ID NO:193. The designed EaD4S gene (SEQ ID NO:192) was synthesized by GenScript Corporation (Piscataway, N.J.) and was cloned into pUC57 (GenBank Accession No. Y14837) to generate pEaD4S (SEQ ID NO:196).

To analyze the function of the codon-optimized EaD4S gene, plasmid pZKL4-220EA4 (FIG. 52B; SEQ ID NO:362) was constructed to integrate two chimeric C20 elongase genes and the chimeric EaD4S gene into the lipase 4 like locus (GenBank Accession No. XM_503825) of *Yarrowia lipolytica* strain Y4184U4. Plasmid pZKL4-220EA4 contained the following components:

TABLE 28

| Components Of Plasmid pZKL4-220EA4 (SEQ ID NO: 362) | |
|---|---|
| RE Sites And Nucleotides Within SEQ ID NO: 362 | Description Of Fragment And Chimeric Gene Components |
| Asc I/BsiW I (4875-4123) | 745 bp 5' portion of the *Yarrowia* Lipase 4 like gene (SEQ ID NO: 363; GenBank Accession No. XM_503825) |
| PacI/SphI (8371-7583) | 782 bp 3' portion of *Yarrowia* Lipase 4 like gene (SEQ ID NO: 363; GenBank Accession No. XM_503825) |
| Swa I/BsiW I (1980-4123) | FBAINm::EaC20ES::Pex20, comprising: FBAINm: *Yarrowia lipolytica* FBAINm promoter (PCT Publication No. WO 2005/049805; U.S. Pat. No. 7,202,356); |

TABLE 28-continued

Components Of Plasmid pZKL4-220EA4 (SEQ ID NO: 362)

| RE Sites And Nucleotides Within SEQ ID NO: 362 | Description Of Fragment And Chimeric Gene Components |
|---|---|
| | EaC20ES: codon-optimized C20 elongase gene (SEQ ID NO: 188; Example 33), derived from *Euglena anabaena*; Pex20: Pex20 terminator sequence from *Yarrowia* Pex20 gene (GenBank Accession No. AF054613) |
| Pme I/Swa I (1-1980) | YAT1::EgC20ES::Lip1, comprising: YAT1: *Yarrowia lipolytica* YAT1 promoter (Patent Publication No. U.S. 2006/0094102-A1); EgC20ES: codon-optimized C20 elongase gene (SEQ ID NO: 183; Example 32), derived from *Euglena gracilis*; Lip1: Lip1 terminator sequence from *Yarrowia* Lip1 gene (GenBank Accession No. Z50020) |
| Cla I/Pme I (1-10472) | EXP1::EaD4S::Lip2, comprising: EXP1: *Yarrowia lipolytica* export protein promoter (PCT Publication No. WO 2006/052870 and U.S. Patent Application No. 11/265761); EaD4S: codon-optimized delta-4 desaturase gene (SEQ ID NO: 192), derived from *Euglena anabaena*; Lip2: Lip2 terminator sequence from *Yarrowia* Lip2 gene (GenBank Accession No. AJ012632) |
| Sal I/EcoR I (10022-8403) | *Yarrowia* Ura3 gene (GenBank Accession No. AJ306421) |

Plasmid pZKL4-220EA4 was digested with AscI/SphI, and then transformed into *Yarrowia lipolytica* strain Y4184U4, as described in the General Methods. The transformants were selected on MM plates. After 5 days growth at 30° C., 8 transformants grown on the MM plates were picked and re-streaked onto fresh MM plates. Once grown, these strains were individually inoculated into 3 mL liquid MM at 30° C. and shaken at 250 rpm/min for 2 days. The cells were collected by centrifugation, resuspended in HGM and then shaken at 250 rpm/min for 5 days. The cells were collected by centrifugation, lipids were extracted, and fatty acid methyl esters were prepared by trans-esterification, and subsequently analyzed with a Hewlett-Packard 6890 GC.

GC analyses showed that there were an average of 0.4% DHA and 10.2% DPA of total lipids produced in all 8 transformants, wherein the conversion efficiency of DPA to DHA in these 8 strains was determined to be about 4.2% (calculated as described in Example 27). Thus, this experimental data demonstrated that the synthetic *Euglena anabaena* delta-4 desaturase codon-optimized for expression in *Yarrowia lipolytica* (i.e., EaD4S, as set forth in SEQ ID NO:192) is active, but functions with relatively low conversion efficiency.

Example 35

Co-expression of the *Euglena gracilis* DHA Synthase 1 C20 Elongase Domain (EqDHAsvn1 C20EloDom1) with the *Schizochytrium aggregatum* Delta-4 Desaturase (SaD4) in Soybean Embryos Transformed with Soybean Expression Vector pKR1105

The following example describes the generation of transgenic soybean events expressing EgDHAsyn1C20EloDom1 and SaD4 that, when generated into plants, could be crossed with EPA-producing soybean events to generate DHA-producing plants.

Soybean embryogenic suspension culture (cv. Jack) was transformed with the AscI fragment of pKR1105 (SEQ ID NO:156; FIG. 16A; fragment containing the expression cassette) and embryos were matured as described for production in Example 25 but with the following change. After maturation on SB103 for 10-12 days, a single cluster of embryos for each event was removed to 4 mL of SB148 liquid media (recipe below) containing 0.02% tergitol and 0.33 mM EPA in a six-well micro-titer plate.

SB 103 Solid Medium (Per Liter)

1 package MS salts (Gibco/BRL—Cat. No. 11117-066)
1 mL B5 vitamins 1000× stock
60 g maltose
pH 5.7

Clusters were carefully broken up to release individual embryos and micro-titer plates were shaken on a rotary shaker at 150 rpm and 26° C. under cool white fluorescent lights on a 16:8 hr day/night photoperiod at a light intensity of 60-85 µE/m2/s for 48 hrs. After 48 hrs, embryos were rinsed with water, dried and five embryos per event were picked into glass GC vials. Fatty acid methyl esters were prepared by transesterification with TMSH and were quantified using a Hewlett-Packard 6890 Gas Chromatograph fitted with an Omegawax 320 fused silica capillary column (Cat. No. 24152, Supelco Inc.) as described in Example 30. The oven temperature was programmed to hold at 150° C. for 1 min and then was increased to 240° C. at 5° C. Retention times were compared to those for methyl esters of standards commercially available (Nu-Chek Prep, Inc.).

In this way, 122 events transformed with pKR1105 were analyzed. From the 122 events analyzed, 49 were identified that elongated EPA (C20/delta-5 elongase activity) and of these, 41 were identified that desaturated DPA (delta-4 desaturase activity) to produce DHA. The events with the best C20/delta-5 elongase and delta-4 desaturase activities were advanced and the fatty acid profiles from feeding embryos with EPA are shown in FIG. 26.

Fatty acids in FIG. 26 are identified as 16:0 (palmitate), 18:0 (stearic acid), 18:1 (oleic acid), LA, ALA, EPA, 22:0 (docosanoic acid), DPA, 24:0 (tetracosanoic acid), DHA and 24:1 (nevonic acid); and, fatty acid compositions listed in FIG. 26 are expressed as a weight percent (wt. %) of total fatty acids. The activity of the EgDHAsyn1C20EloDom1 is expressed as percent C20/delta-5 elongation (% C20/delta-5 elong), calculated according to the following formula: ([product]/[substrate+product])*100. More specifically, the combined percent elongation for EPA is shown as "% C20/delta-5 elong", determined as: ([DPA+DHA]/[EPA+DPA+DHA])*100.

The activity of the SaD4 is expressed as percent delta-4 desaturation (% delta-4 desat), calculated according to the following formula: ([product]/[substrate+product])*100. More specifically, the combined percent desaturation for DPA is shown as "% delta-4 desat", determined as: (DHA/[DPA+DHA])*100.

Example 36

Identification of a Delta-9 Elongase From *Euglena anabaena* UTEX 373

The present example describes the identification of delta-9 elongases from a *Euglena anabaena* UTEX 373 cDNA library. This work is also described in U.S. Provisional Application No. 60/911,925 (filed Apr. 16, 2007; the contents of which are hereby incorporated by reference).

Growth of *Euglena anabaena* UTEX 373 and preparation of RNA

Amplified cDNA library eug1c was plated and colonies lifted as described in Example 13. A DNA probe was made using an agarose gel purified NcoI/NotI DNA fragment containing the *Euglena gracilis* delta-9 elongase gene, from pKR906 (SEQ ID NO:115; Example 16 and WO 2007/061845, which published May 31, 2007; the contents of which are hereby incorporated by reference) labeled with $P^{32}$ dCTP using the RadPrime DNA Labeling System (Cat. No. 18428-011, Invitrogen, Carlsbad, Calif.) following the manufacturer's instructions.

Colony lifts were probed and positives were identified and confirmed as described in Example 13. Plasmid DNA was isolated and sequenced exactly as described in Example 2 and sequences were aligned and compared using Sequencher™ (Version 4.2, Gene Codes Corporation, Ann Arbor, Mich.). In this way, the clones could be categorized into one of two distinct groups based on insert sequence (designated EaD9Elo1 and EaD9Elo2). Representative clones containing the cDNA for each class of sequence were chosen for further study, and the sequences for each representative plasmid (pLF121-1 and pLF121-2) are shown in SEQ ID NO:250 and SEQ ID NO:251, respectively. The sequence shown by a string of NNNN's represents a region of the polyA tail which was not sequenced. The coding sequences for EaD9Elo1 and EaD9Elo2 are shown in SEQ ID NO:252 and SEQ ID NO:253, respectively. The corresponding amino acid sequences for EaD9Elo1 and EaD9Elo2 are shown in SEQ ID NO:254 and SEQ ID NO:255, respectively.

Example 37

Identification of a Delta-5 Desaturase from *Euglena anabaena* UTEX 373

The present Example describes the identification of a delta-5 desaturase from *Euglena anabaena* UTEX 373. This work is also described in U.S. Provisional Application No. 60/915,733 (filed May 3, 2007; the contents of which are hereby incorporated by reference).

Amplified cDNA library eug1c was plated and colonies lifted as described in Example 13. A DNA probe was made using an agarose gel purified NcoI/NotI DNA fragment containing the *Euglena gracilis* delta-5 desaturase gene (EgD5; SEQ ID NO:267) from pDMW367, previously described in PCT Publication No. WO 2007/136877 (published Nov. 29, 2007; the contents of which are hereby incorporated by reference), labeled with $P^{32}$.

Colony lifts were probed and positives were identified and confirmed as described in Example 13. Plasmid DNA was isolated and sequenced exactly as described in Example 2, and sequences were aligned and compared using Sequencher™ (Version 4.2, Gene Codes Corporation, Ann Arbor, Mich.).

A representative clone containing a cDNA (pLF119) is shown in SEQ ID NO:256 and the gene contained within the cDNA was called EaD5Des1. The coding sequence for EaD5Des1 is shown in SEQ ID NO:257. The corresponding amino acid sequence for EaD5Des1 is shown in SEQ ID NO:258.

Example 38

Construction of Soybean Expression Vector pKR1183 for Expression of a *Euglena anabaena* delta-9 elongase-*Tetruetreptia pomguetensis* CCMP1491 Delta-8 Desaturase Fusion Gene (Hybrid1-HGLA Synthase)

An in-frame fusion between the *Euglena anabaena* delta-9 elongase (EaD9Elo1; SEQ ID NO:252; Example 36), the *Euglena gracilis* DHA synthase 1 proline-rich linker (EgDHAsyn1Link; SEQ ID NO:197; Example 6) and the *Tetruetreptia pomquetensis* CCMP1491 delta-8 desaturase (TpomD8; SEQ ID NO:162; Example 21; see also Applicants' Assignee's co-pending application having U.S. patent application Ser. No. 11/876,115 (filed Oct. 22, 2007)) was constructed using the conditions described below.

An initial in-frame fusion between the EaD9Elo1 and the EgDHAsyn1 Link (EaD9elo-EgDHAsyn1 Link) was made, flanked by an NcoI site at the 5' end and a NotI site at the 3' end, by PCR amplification. EaD9Elo1 (SEQ ID NO:252) was amplified from pLF121-1 (SEQ ID NO:250) with oligonucleotides EaD9-5Bbs (SEQ ID NO:259) and EaD9-3fusion (SEQ ID NO:260), using the Phusion™ High-Fidelity DNA Polymerase (Cat. No. F553S, Finnzymes Oy, Finland) following the manufacturer's protocol. EgDHAsyn1 Link (SEQ ID NO:197) was amplified in a similar way from pKR1049 (Example 4) with oligonucleotides EgDHAsyn1 Link-5fusion (SEQ ID NO:261) and MWG511 (SEQ ID NO:175). The two resulting PCR products were combined and re-amplified using EaD9-5Bbs (SEQ ID NO:259) and MWG511 (SEQ ID NO:175) to form EaD9Elo1-EgDHAsyn1 Link. The sequence of the EaD9Elo1-EgDHAsyn1 Link is shown in SEQ ID NO:262. EaD9Elo1-EgDHAsyn1 Link does not contain an in-frame stop codon upstream of the NotI site at the 3' end and therefore, a DNA fragment cloned into the NotI site can give rise to an in-frame fusion with the EgD9elo1-EgDHAsyn1Link if the correct frame is chosen. EaD9Elo1-EgDHAsyn1 Link was cloned into the pCR-Blunt® cloning vector using the Zero Blunt® PCR Cloning Kit (Invitrogen Corporation), following the manufacturer's protocol, to produce pLF124 (SEQ ID NO:263).

The BbsI/NotI DNA fragment of pLF124 (SEQ ID NO:263), containing EaD9Elo1-EgDHAsyn1 Link, was cloned into the NcoI/NotI DNA fragment from KS366 (SEQ ID NO:177; Example 23), containing the promoter for the α' subunit of β-conglycinin, to produce pKR1177 (SEQ ID NO:264).

The BamHI DNA fragment of pKR1177 (SEQ ID NO:264), containing EaD9Elo1-EgDHAsyn1 Link, was cloned into the BamHI DNA fragment of pKR325, previously described in PCT Publication No. WO 2006/012325 (the contents of which are hereby incorporated by reference) to produce pKR1179 (SEQ ID NO:265).

The NotI fragment from pLF114-10 (Example 21; SEQ ID NO:165), containing TpomD8 was cloned into the NotI fragment of pKR1179 (SEQ ID NO:265) to produce pKR1183 (SEQ ID NO:266; FIG. 28). In FIG. 28, the fusion gene (Hybrid1-HGLA synthase) is called EAd9ELONG-TPOMd8DS.

Example 39

Construction of Soybean Expression Vector pKR1253 for Expression of a *Euglena anabaena* delta-9 elongase-*Tetruetreptia pomquetensis* CCMP1491 Delta-8 Desaturase Fusion Gene (Hybrid1-HGLA Synthase) with a *Euglena gracilis* Delta-5 Desaturase Through a number of subcloning steps, a NotI site was added to the 5' end of the *Euglena gracilis* delta-5 desaturase (EgD5; SEQ ID NO:267) from pDMW367 and this NotI fragment containing EgD5 was cloned into the NotI site of pKR457 (SEQ ID NO:122; Example 16) to produce pKR1237 (SEQ ID NO:268).

The AscI fragment of pKR1183 (SEQ ID NO:266; Example 38), containing the Hybrid1-HGLA synthase, was cloned into the AscI fragment of pKR277 (SEQ ID NO:120, which was previously described in PCT Publication No. WO 2004/071467 and published Aug. 26, 2004; (the contents of which are hereby incorporated by reference) to produce pKR1252 (SEQ ID NO:269).

The BsiWI fragment of pKR1237 (SEQ ID NO:268), containing the EgD5 gene, was cloned into the BsiWI site of pKR1252 (SEQ ID NO:269) to produce pKR1253 (SEQ ID NO:270; FIG. 30).

Example 40

Construction of Soybean Vector pKR1139 for Expression of a *Euglena anabaena* Delta-5 Desaturase The present example describes the cloning of a delta-5 desaturase from *Euglena anabaena* UTEX 373 into a soybean expression vector. This work is also described in U.S. Provisional Application No. 60/915,733 (filed May 3, 2007; (the contents of which are hereby incorporated by reference)).

EaD5Des1 (SEQ ID NO:257) was amplified from pLF119 (SEQ ID NO:256, Example 37) with oEAd5-1-1 (SEQ ID NO:271) and oEAd5-1-2 (SEQ ID NO:272), using the Phusion™ High-Fidelity DNA Polymerase (Cat. No. F553S, Finnzymes Oy, Finland) following the manufacturer's protocol. The resulting PCR product was cloned into the pCR-Blunt® cloning vector using the Zero Blunt® PCR Cloning Kit (Invitrogen Corporation), following the manufacturer's protocol, to produce pKR1136 (SEQ ID NO:273).

The NotI fragment for pKR1136 (SEQ ID NO:273) containing the EaD5Des1 was cloned into the NotI fragment of pKR974, previously described in PCT Publication No. WO 2007/136877, published Nov. 29, 2007 (the contents of which are hereby incorporated by reference), to produce pKR1139 (SEQ ID NO:274).

Example 41

Construction of Soybean Expression Vector pKR1255 for Expression of a *Euglena anabaena* Delta-9 Elongase-*Tetruetreptia pomquetensis* CCMP1491 Delta-8 Desaturase Fusion Gene (Hybrid1-HGLA Synthase) with a *Euglena gracilis* Delta-5 Desaturase and a *Euglena anabaena* Delta-5 Desaturase Plasmid pKR1139 (SEQ ID NO:274; Example 40) was digested with SbfI and the fragment containing the EaD5Des1 was cloned into the SbfI site of pKR1253 (SEQ ID NO:270; Example 39) to produce pKR1255 (SEQ ID NO:275; FIG. 31).

Example 42

Construction of Soybean Expression Vector pKR1189 for Down-Regulating Expression of Soybean Fad3

The present example describes a soybean expression vector designed to decrease fad3 expression in soybean.

A starting vector pKR561 (SEQ ID NO:276) was assembled by inserting the BsiWI fragment of pKR268 (previously described in PCT Publication No. WO 04/071467) containing the annexin promoter into the BsiWI site of pKR145, which is described in PCT Publication No. WO 04/071467.

Plasmid XF1, described in PCT Publication No. WO 93/11245 (which was published on Jun. 10, 1993; also U.S. Pat. No. 5,952,544; the contents of which are hereby incorporated by reference), contains the soybean delta-15 desaturase (fad3) gene (SEQ ID NO:277; GenBank Accession No. L22964; also called GmFAD3B).

A portion of the 5' end of the fad3 gene was amplified from XF1 with the Phusion™ High-Fidelity DNA Polymerase (Cat. No. F553S, Finnzymes Oy, Finland) following the manufacturer's protocol, using HPfad3-1 (SEQ ID NO:278) and HPfad3-2 (SEQ ID NO:279) to produce a DNA fragment called HPfad3AB (SEQ ID NO:280).

A portion of the 3' end of the fad3 gene was amplified from XF1 with the Phusion™ High-Fidelity DNA Polymerase, using HPfad3-3 (SEQ ID NO:281) and HPfad3-1 (SEQ ID NO:278) to produce a DNA fragment called HPfad3A'-2 (SEQ ID NO:282).

HPfad3AB and HPfad3A'-2 were combined and amplified using the Phusion™ High-Fidelity DNA Polymerase with HPfad3-1 (SEQ ID NO:278) to produce HPfad3ABA'-2 (SEQ ID NO:283). HPfad3ABA'-2 (SEQ ID NO:283) has a NotI site at both the 5' and 3' end of the DNA fragment. The resulting PCR product was cloned into the pCR-Blunt® cloning vector using the Zero Blunt® PCR Cloning Kit (Invitrogen Corporation), following the manufacturer's protocol, to produce pLF129 (SEQ ID NO:284).

The NotI fragment for pLF129 (SEQ ID NO:284) containing the fad3 hairpin was cloned into the NotI fragment of pKR561 (SEQ ID NO:276) to produce pKR1189 (SEQ ID NO:285; FIG. 32). In FIG. 32, the A and A' domains for fad3 are indicated by the designation TR1 while the B domain is indicated by TR2.

Example 43

Construction of Soybean Expression Vector pKR1249 for Down-Regulating Soybean Fad3 and Soybean Fad3c The NotI/HindIII fragment of pLF129 (SEQ ID NO:284) containing the TR1 and TR2 domains of fad3, as indicated in FIG. 32, was cloned into the NotI/HindIII backbone fragment of pLF129 (SEQ ID NO:284) to produce pKR1209 (SEQ ID NO:286).

The coding sequence of GmFad3C (GenBank Accession No. AY204712) (Bilyeu et al., *Crop Sci.* 43:1833-1838 (2003); Anai et al., *Plant Sci.* 168:1615-1623 (2005)) is shown in SEQ ID NO:287 and the corresponding amino acid sequence is shown in SEQ ID NO:288. A portion of the fad3c gene was amplified from the soybean cDNA library described in PCT Publication No. WO 93/11245 (which was published on Jun. 10, 1993; also U.S. Pat. No. 5,952,544) (the contents of which are hereby incorporated by reference) with the Phusion™ High-Fidelity DNA Polymerase (Cat. No. F553S, Finnzymes Oy, Finland) following the manufacturer's protocol, using fad3c-5 (SEQ ID NO:289) and fad3c-3 (SEQ ID NO:290). The resulting DNA fragment was cloned into the pCR-Blunt® cloning vector using the Zero Blunt® PCR Cloning Kit (Invitrogen Corporation), following the manufacturer's protocol, to produce pKR1213 (SEQ ID NO:291).

The EcoRV/XhoI fragment of pKR1213 (SEQ ID NO:291) containing the fragment of fad3c was cloned into the NotI (filled)/XhoI site of pKR1209 (SEQ ID NO:286) to produce pKR1218 (SEQ ID NO:292).

The NotI/HindIII fragment of pLF129 (SEQ ID NO:284) containing the TR1 domain only from fad3, as indicated in FIG. 32, was cloned into the NotI/HindIII backbone fragment of pLF129 (SEQ ID NO:284) to produce pKR1210 (SEQ ID NO:293).

The EcoRV/XhoI fragment of pKR1213 (SEQ ID NO:291) containing the fragment of fad3c was cloned into the NotI (filled)/XhoI site of pKR1210 (SEQ ID NO:293) to produce pKR1219 (SEQ ID NO:294).

The XhoI(filled)/HindIII fragment of pKR1218 (SEQ ID NO:292) containing the fragment of fad3c as well as fad3 TR1 and TR2 domains was cloned into the MluI(filled)/HindIII site of pKR1219 (SEQ ID NO:294), containing the fragment of fad3c as well as the fad3 TR1 only domain, to produce pKR1225 (SEQ ID NO:295). In this way, a new hairpin including fad3 and fad3c and flanked by NotI sites was formed.

The NotI fragment for pKR1225 (SEQ ID NO:295) containing the new hairpin including fad3 and fad3c was cloned into the NotI fragment of pKR561 (SEQ ID NO:276; Example 42) to produce pKR1229 (SEQ ID NO:296; FIG. 33). In this way, the fad3/fad3c hairpin can be expressed from a strong, seed-specific promoter with hygromycin selection in plants.

The BsiWI fragment for pKR1225 (SEQ ID NO:295) containing the new hairpin including fad3 and fad3c was cloned into the BsiWI fragment of pKR226 (SEQ ID NO:130; Example 17) to produce pKR1249 (SEQ ID NO:297; FIG. 34). In FIG. 34, pKR1249 is labeled pKR1249_PHP33240. In this way, the fad3/fad3c hairpin can be expressed from a strong, seed-specific promoter with chlorsulfuron (ALS) selection in plants.

Example 44

Construction of Soybean Expression Vector pKR1322 for Expression of a *Euglena anabaena* delta-9 elongase-*Tetruetreptia pomquetensis* CCMP1491 Delta-8 Desaturase-*Euglena anabaena* delta-5 Desaturase Fusion Gene (EaD9Elo1-TpomD8-EaD5Des1 fusion)

The present example describes the construction of an in-frame fusion gene between the *Euglena anabaena* delta-9 elongase (EaD9Elo1; SEQ ID NO:252, Example 36), the *Tetruetreptia pomquetensis* CCMP1491 delta-8 Desaturase (TpomD8; SEQ ID NO:162; Example 21) and the *Euglena anabaena* delta-5 desaturase (EaD5Des1; SEQ ID NO:257; Example 37). Each domain is separated by the EgDHAsyn1 linker (EgDHAsyn1 Link; SEQ ID NO:197; Example 6).

The EaD9Elo1-EgDHAsyn1 Link (SEQ ID NO:262; Example 38) was amplified from pLF124 (SEQ ID NO:263) with oligonucleotides oEAd9el1-1 (SEQ ID NO:298) and oLINK-1 (SEQ ID NO:299), using the Phusion™ High-Fidelity DNA Polymerase (Cat. No. F553S, Finnzymes Oy, Finland) following the manufacturer's protocol. EaD9Elo1-EgDHAsyn1 Link is flanked by NotI at the 5' end and EagI at the 5' and 3' ends and does not contain an in-frame stop codon upstream of the EagI site at the 3' end. Therefore, a DNA fragment cloned into the EagI site can give rise to an in-frame fusion with the EgD9elo-EgDHAsyn1 Link if the correct frame is chosen. The resulting DNA fragment containing EaD9Elo1-EgDHAsyn1 Link was cloned into the pCR-Blunt® cloning vector using the Zero Blunt® PCR Cloning Kit (Invitrogen Corporation), following the manufacturer's protocol, to produce pKR1298 (SEQ ID NO:300).

An in-frame fusion between the TpomD8 and the EgDHAsyn1 Link (TpomD8-EgDHAsyn1 Link) was made which contained a NotI site at the 5' end and EagI sites at the 5' and 3' ends, by PCR amplification. TpomD8 (SEQ ID NO:162) was amplified from pLF114-10 (SEQ ID NO:165) with oligonucleotides oTPd8-1 (SEQ ID NO:301) and oTPd8fus-1 (SEQ ID NO:302), using the Phusion™ High-Fidelity DNA Polymerase (Cat. No. F553S, Finnzymes Oy, Finland) following the manufacturer's protocol. EgDHAsyn1 Link (SEQ ID NO:197) was amplified in a similar way from pKR1049 (Example 4) with oligonucleotides oLINK-2 (SEQ ID NO:303) and oLINK-1 (SEQ ID NO:304). The two resulting PCR products were combined and re-amplifed using oTPd8-1 (SEQ ID NO:301) and oLINK-1 (SEQ ID NO:304) to form TpomD8-EgDHAsyn1Link (SEQ ID NO:305). TpomD8-EgDHAsyn1Link was cloned into the pCR-Blunt® cloning vector using the Zero Blunt® PCR Cloning Kit (Invitrogen Corporation), following the manufacturer's protocol, to produce pKR1291 (SEQ ID NO:306).

The EagI fragment of pKR1291, containing the TpomD8-EgDHAsyn1Link was cloned into the NotI site of pBluescript II SK(+) vector (Stratagene) to form either pKR1301 (SEQ ID NO:307) in one orientation or pKR1301R (SEQ ID NO:308) in the opposite orientation.

Plasmid pKR1301 (SEQ ID NO:307) was digested with MfeI/BamHI, the DNA fragment containing TpomD8-EgDHAsyn1Link was completely filled in, and the resulting DNA fragment was re-ligated to form pKR1311 (SEQ ID NO:309).

Plasmid pKR1301R (SEQ ID NO:308) was digested with EcoRI, and the fragment containing the 5' end of TpomD8-EgDHAsyn1 Link (called TPOMD8TR2) and vector backbone was re-ligated to form pKR1304 (SEQ ID NO:310).

The EagI site of pKR1298 (SEQ ID NO:300) containing the EaD9Elo1-EgDHAsyn1 Link was cloned into the EagI site of pKR1304 (SEQ ID NO:310) to produce pKR1309 (SEQ ID NO:311).

The NotI site of pKR1298 (SEQ ID NO:300) containing the EaD9Elo1-EgDHAsyn1 Link was cloned into the EagI site of pKR1304 (SEQ ID NO:310) to produce pKR1309 (SEQ ID NO:311).

The NotI fragment for pKR1136 (SEQ ID NO:273; Example 40) containing the EaD5Des1 was cloned into the EagI site of pKR1311 (SEQ ID NO:309) to produce pKR1313 (SEQ ID NO:312).

The MfeI/Ecl13611 fragment of pKR1313 (SEQ ID NO:312) was cloned into the EcoRV/MfeI sites of pKR1309 (SEQ ID NO:311) to produce pKR1315 (SEQ ID NO:313).

The NotI fragment of pKR1315 (SEQ ID NO:313) was cloned into the NotI site of pKR72 (SEQ ID NO:105; Example 15) to produce pKR1322 (SEQ ID NO:314; FIG. 35).

In FIG. 35, the EaD9Elo1-TpomD8-EaD5Des1 fusion is labeled as EAd9el+TPd8ds+EAd5ds fusion.

Example 45

Down-Regulation of the Soybean fad3 and fad3c Genes in Soybean Somatic Embryos by Transformation with pKR1189 or pKR1229

The present example describes the transformation and expression in soybean somatic embryos of pKR1189 (SEQ ID NO:285, Example 42), containing a fad3 hairpin construct or pKR1229 (SEQ ID NO:296; Example 43), containing a fad3 and fad3c hairpin construct. Both constructs also have the hygromycin phosphotransferase gene for selection on hygromycin.

Soybean embryogenic suspension culture (cv. Jack) was transformed with pKR1189 (SEQ ID NO:285) or pKR1229 (SEQ ID NO:296) and embryos were matured in soybean histodifferentiation and maturation liquid medium (SHaM liquid media; Schmidt et al., *Cell Biology* and *Morphogenesis*, 24:393 (2005)) as described in Example 25 and previously described in PCT Publication No. WO 2007/136877, published Nov. 29, 2007 (the contents of which are hereby incorporated by reference).

After maturation in SHaM liquid media, individual embryos were removed from the clusters, dried and screened for alterations in their fatty acid compositions as described in Example 1. In each case, a subset of soybean embryos (i.e., five embryos per event) transformed with either pKR1189 (SEQ ID NO:285) or pKR1229 (SEQ ID NO:296) were harvested and analyzed.

In this way, 41 events transformed with pKR1189 (SEQ ID NO:285; Experiment 2148) or pKR1229 (SEQ ID NO:296; Experiment 2165) were analyzed. The fatty acid profiles for the five events having the lowest average ALA content (average of the 5 embryos analyzed) along with an event (2148-3-8-1) having a fatty acid profile typical of wild type embryos for this experiment, are shown in FIG. 36. In FIG. 36, fatty acids are identified as 16:0 (palmitate), 18:0 (stearic acid), 18:1 (oleic acid), LA, and ALA. Fatty acid compositions are expressed as a weight percent (wt. %) of total fatty acids.

ALA content in somatic embryos expressing either a fad3 hairpin construct (event number 2148, FIG. 36) or a fad3c hairpin construct (event number 2165, FIG. 36) showed at least a 50% reduction when compared to typical wild type embryos (FIG. 36). This strongly indicates that either hairpin construct is functional to decrease ALA content in soybean embryos.

Example 46

Soybean Somatic Embryos Transformed with pKR1183 for Expression of a *Euglena anabaena* Delta-9 Elongase-*Tetruetreptia pomquetensis* CCMP1491 Delta-8 Desaturase Fusion Gene (Hybrid1-HGLA Synthase)

The present example describes the transformation and expression in soybean somatic embryos of pKR1183 (SEQ ID NO:266; Example 38) containing the *Euglena anabaena* delta-9 elongase-Tetruetreptia pomquetensis CCMP1491 delta-8 Desaturase Fusion Gene (Hybrid1-HGLA Synthase) and the hygromycin phosphotransferase gene for selection on hygromycin.

Soybean embryogenic suspension culture (cv. Jack) was transformed with pKR1183 (SEQ ID NO:266) and embryos were matured in soybean histodifferentiation and maturation liquid medium (SHaM liquid media; Schmidt et al., *Cell Biology* and *Morphogenesis*, 24:393 (2005)) as described in Example 25 and previously described in PCT Publication No. WO 2007/136877, published Nov. 29, 2007 (the contents of which are hereby incorporated by reference).

After maturation in SHaM liquid media a subset of soybean embryos (i.e., four embryos per event) transformed with pKR1183 (SEQ ID NO:266) were harvested and analyzed as described herein.

In this way, 20 events transformed with pKR1183 (SEQ ID NO:266; Experiment 2145) were analyzed. The fatty acid profiles for the five events having the highest average DGLA content (average of the 5 embryos analyzed) are shown in FIG. 37. In FIG. 37, fatty acids are identified as 16:0 (palmitate), 18:0 (stearic acid), 18:1 (oleic acid), LA, ALA, EDA, ERA, DGLA and ETA. Fatty acid compositions are expressed as a weight percent (wt. %) of total fatty acids.

Example 47

Soybean Embryos Transformed with Soybean Expression Vectors pKR1253 for Expression of a *Euglena anabaena* delta-9 elongase-*Tetruetreptia pomquetensis* CCMP1491 Delta-8 Desaturase Fusion Gene (Hybrid1-HGLA Synthase) with a *Euglena gracilis* delta-5 desaturase and pKR1249 for Down-Regulating Soybean Fad3 and Soybean Fad3c Soybean embryogenic suspension culture (cv. Jack) was transformed with the AscI fragments of pKR1249 (SEQ ID NO:297; Example 43) and pKR1253 (SEQ ID NO:270; Example 39) as described in Example 25. A subset of soybean embryos generated from each event (ten embryos per event) were harvested, picked into glass GC vials and fatty acid methyl esters (FAMEs) were prepared by transesterification and analyzed by GC as described in Example 1. Retention times were compared to those for methyl esters of standards commercially available (Nu-Chek Prep, Inc.).

In this way, 142 events transformed with pKR1249 (SEQ ID NO:297) and pKR1253 (SEQ ID NO:270) (experiment called Heal 25) were analyzed. From the 142 events analyzed, 90 were identified that produced ARA in at least one embryo out of ten analyzed at a relative abundance greater than 1.0% of the total fatty acids. Of these, 64 were identified that produced ARA in at least one embryo out of ten analyzed at a relative abundance greater than 10.0% of the total fatty acids. Of these, 44 events were identified that produced ARA in at least one embryo out of ten analyzed at a relative abundance greater than 20.0% of the total fatty acids.

The average fatty acid profiles (Average of 10 embryos) for 20 events having the highest ARA are shown in FIG. 38. Fatty acids are identified as 16:0 (palmitate), 18:0 (stearic acid), 18:1 (oleic acid), LA, ALA, EDA, SCI, DGLA, ARA, ERA, JUN, ETA and EPA; and fatty acid compositions listed in FIG. 38 are expressed as a weight percent (wt. %) of total fatty acids. For FIG. 38, fatty acids listed as "others" include: 18:2 (5,9), 18:3 (5,9,12), STA, 20:0, 20:1 (11), 20:2 (7,11) or 20:2 (8,11) and DPA. Each of these fatty acids is present at a relative abundance of less than 2.0% of the total fatty acids. Average total omega-3 fatty acid (Total n-3) is the sum of the averages of all omega-3 fatty acids).

The actual fatty acid profiles for each embryo from one event (AFS 5416-8-1-1) having an average ARA content of 17.0% and an average EPA content of 1.5% is shown in FIG. 39. Fatty acids are identified as 16:0 (palmitate), 18:0 (stearic acid), 18:1 (oleic acid), LA, ALA, EDA, SCI, DGLA, ARA, ERA, JUN, ETA and EPA; and fatty acid compositions listed in FIG. 39 are expressed as a weight percent (wt. %) of total fatty acids. For FIG. 39, fatty acids listed as "others" include: 18:2 (5,9), 18:3 (5,9,12), STA, 20:0, 20:1 (11), 20:2 (7,11) or 20:2 (8,11) and DPA. Each of these fatty acids is present at a relative abundance of less than 2.0% of the total fatty acids. Total omega-3 fatty acid (Total n-3) is the sum of all omega-3 fatty acids).

Because ALA contents is generally 1.5- to 3-fold higher in soybean somatic embryos than it is in seed (i.e., 15%-30% in embryos (see, for example, typical wild type embryo in FIG. 36), depending on maturation conditions and time versus 7-10% in a seed (Bilyeu et al., 2005, Crop Sci. 45:1830-1836), it is expected that omega-3 contents in general and EPA contents specifically, will be significantly lower in seed than somatic embryos.

Example 48

Soybean Embryos Transformed with Soybean Expression Vectors pKR1255 for Expression of a *Euglena anabaena* delta-9 elongase-*Tetruetreptia pomquetensis* CCMP1491 Delta-8 Desaturase Fusion Gene (Hybrid1-HGLA Synthase) with a *Euglena gracilis* Delta-5 Desaturase and a *Euglena anabaena* Delta-5 Desaturase and pKR1249 For Down-Regulating Soybean Fad3 and Soybean Fad3c Soybean embryogenic suspension culture (cv. Jack) was transformed with the AscI fragments of pKR1249 (SEQ ID NO:297; Example 43) and pKR1255 (SEQ ID NO:275; Example 41) as described in Example 25. A subset of soybean embryos generated from each event (ten embryos per event) were harvested, picked into glass GC vials and fatty acid methyl esters (FAMEs) were prepared by transesterification and analyzed by GC as described in Example 1. Retention times were compared to those for methyl esters of standards commercially available (Nu-Chek Prep, Inc.).

In this way, 197 events transformed with pKR1249 (SEQ ID NO:297) and pKR1255 (SEQ ID NO:275) (experiment called Heal 26) were analyzed. From the 197 events analyzed, 128 were identified that produced ARA in at least one embryo out of ten analyzed at a relative abundance greater than 1.0% of the total fatty acids. Of these, 105 were identified that produced ARA in at least one embryo out of ten analyzed at a relative abundance greater than 10.0% of the total fatty acids. And of these, 83 events were identified that produced ARA in at least one embryo out of ten analyzed at a relative abundance greater than 20.0% of the total fatty acids.

The average fatty acid profiles (Average of 9 or 10 embryos) for 20 events having the highest ARA are shown in FIG. 40. Fatty acids are identified as 16:0 (palmitate), 18:0 (stearic acid), 18:1 (oleic acid), LA, ALA, EDA, SCI, DGLA, ARA, ERA, JUN, ETA and EPA; and, fatty acid compositions listed in FIG. 40 are expressed as a weight percent (wt. %) of total fatty acids. For FIG. 40, fatty acids listed as "others" include: 18:2 (5,9), 18:3 (5,9,12), STA, 20:0, 20:1 (11), 20:2 (7,11) or 20:2 (8,11) and DPA. Each of these fatty acids is present at a relative abundance of less than 2.0% of the total fatty acids. Average total omega-3 fatty acid (Total n-3) is the sum of the averages of all omega-3 fatty acids).

Example 49

Expression of the *Euglena gracilis* DHA Synthase 1 C20 Elongase Domain/*Schizochytrium aggregatum* Delta-4 Desaturase Fusion (EgDHAsyn1C20EloDom3-SaD4) Transformed with Soybean Expression Vector pKR1134

Soybean embryogenic suspension culture (cv. Jack) was transformed with the AscI fragment of pKR1134 (SEQ ID NO:161; Example 20; fragment containing the expression cassette) and embryos were matured as described for production in Example 25. Substrate feeding of EPA and analysis was carried out as described in Example 35.

In this way, 198 events transformed with pKR1134 (Experiment called Heal24) were analyzed. From the 198 events analyzed, 193 were identified that elongated EPA (C20/delta-5 elongase activity) and all of these desaturated DPA (delta-4 desaturase activity) to produce DHA to some extent. The events with the best C20/delta-5 elongase and delta-4 desaturase activities were advanced and the fatty acid profiles from feeding embryos with EPA are shown in FIG. 41.

Fatty acids in FIG. 41 are identified as 16:0 (palmitate), 18:0 (stearic acid), 18:1 (oleic acid), LA, ALA, EPA, 22:0 (docosanoic acid), DPA, 24:0 (tetracosanoic acid), DHA and 24:1 (nevonic acid); and fatty acid compositions listed in FIG. 41 are expressed as a weight percent (wt. %) of total fatty acids. The activity of the EgDHAsyn1C20EloDom1 is expressed as percent C20/delta-5 elongation (% C20/delta-5 elong), calculated according to the following formula: ([product]/[substrate+product])*100. More specifically, the combined percent elongation for EPA is shown as "% C20/delta-5 elong", determined as: ([DPA+DHA]/[EPA+DPA+DHA])*100.

The activity of the SaD4 is expressed as percent delta-4 desaturation (% delta-4 desat), calculated according to the following formula: ([product]/[substrate+product])*100. More specifically, the combined percent desaturation for DPA is shown as "% delta-4 desat", determined as: (DHA/[DPA+DHA])*100.

In addition to the 122 events analyzed for soy transformed with pKR1105 (Experiment called Heal23) as described in Example 35, 20 more events were analyzed since the Example 35 was written bringing the total analyzed to 142 events. From the 20 new events analyzed, 18 were identified that elongated EPA (C20/delta-5 elongase activity) and 17 of these also desaturated DPA (delta-4 desaturase activity) to produce DHA to some extent. The events with the best C20/delta-5 elongase and delta-4 desaturase activities from the 20 new events analyzed for soy transformed with pKR1105 were advanced and the fatty acid profiles from feeding embryos with EPA are shown in FIG. 42.

Relative activities of events transformed with either pKR1105 (C20 elongase and delta-4 desaturase expressed individually) or pKR1134 (C20 elongase and delta-4 desaturase expressed as a fusion) are compared by plotting % DHA (wt. %) vs. % DPA (wt. %) for all events where embryos were fed EPA. The results are plotted in FIG. 43. In FIG. 43, Heal23 is the name of the experiment where pKR1105 was transformed and Heal24 is the experiment where pKR1134 was transformed. From FIG. 43, it is clear that overall, DHA concentrations have increased while DPA concentrations have decreased (to as low as undetectable), when the C20 elongase is fused to the delta-4 desaturase. Thus, fusing the 2 independent enzymes together as one fusion protein separated by a linker region increased flux from EPA to DHA.

Example 50

Expression of a *Euglena anabaena* delta-9 elongase-*Tetruetreptia pomquetensis* CCMP1491 Delta-8 Desaturase-*Euglena anabaena* delta-5 Desaturase Fusion Gene
(EaD9Elo1-TpomD8-EaD5Des1 fusion)

Soybean embryogenic suspension culture (cv. Jack) is transformed with pKR1322 (SEQ ID NO:314) and embryos are matured and analyzed for fatty acid profiles as described herein.

Soybean somatic embryos transformed with pKR1322 (SEQ ID NO:314) will elongate LA to EDA, EDA will be desaturated to DGLA, and DGLA will be further desaturated to ARA. Because wild-type soybean also contains ALA, some ALA will be elongated to ERA, ERA will be desaturated to ETA, and ETA will be further desaturated to EPA.

Soybean plants expressing the fusion gene from pKR1322 can be re-generated from embryos as described in Example 26 and seeds can be obtained.

In backgrounds that contain high ALA, or where a delta-15 desaturase and or delta-17 desaturase has been co-expressed, EPA will predominate. Conversely, ARA can be enriched by using a background low in ALA (for example by crossing to a low ALA or low lin plant) or by knocking out the endogenous fad3 gene(s) as described herein. Intermediate fatty acids (i.e., EDA and DGLA or ERA and ETA) will be lower when the fusion is used than when individual activities are transformed independently (i.e., not a fusion).

Other gene combinations (including linker combinations) can be fused together in a similar way as described in Example 24. Similarly, other promoter/gene fusion/terminator combinations can be made.

Example 51

Determination of the Functional Domain in the Synthetic Delta-4 Desaturase Derived from *Euglena anabaena* and Codon-Optimized for Expression in *Yarrowia lipolytica* (EaD4S)

As schematically diagrammed in FIG. 52C, the C-terminal portion of the C20 elongase domain of EaDHAsyn1 (labeled as "EaC20E" in the figure) appears to overlap with the N-terminal portion of the delta-4 desaturase domain of EaDHAsyn1 (labeled as "EaD4" in the figure). This is suggested by sequence comparison.

In order to define the functional delta-4 desaturase domain in EaD4S (SEQ ID NO:192; Example 34), three EaD4S* mutants with different N-terminal truncations were generated. Specifically, pZuFmEaD4S (SEQ ID NO:364) was constructed by replacing the NcoI/NotI fragment of pZuFmIgD9ES (SEQ ID NO:365) with the NcoI/NotI EaD4S fragment of pEaD4S (SEQ ID NO:196; Example 34). A NcoI site was introduced into pZuFmEaD4S (SEQ ID NO:364) by site-directed mutagenesis using primer pairs YL921 and YL922 (SEQ ID NOs:366 and 367, respectively), YL923 and YL924 (SEQ ID NOs:368 and 369, respectively) and YL925 and YL926 (SEQ ID NOs:370 and 371, respectively) to generate pZuFmEaD4S-M1 (SEQ ID NO:372), pZuFmEaD4S-M2 (SEQ ID NO:373) and pZuFmEaD4S-M3 (SEQ ID NO:374), respectively. The pZuFmEaD4S-M1, pZuFmEaD4S-M2 and pZuFmEaD4S-M3 plasmids were digested with NcoI, and then self-ligated to generate pZuFmEaD4S-1 (SEQ ID NO:375), pZuFmEaD4S-2 (SEQ ID NO:376) and pZuFmEaD4S-3 (SEQ ID NO:377) constructs. The NcoI/NotI fragments containing different truncations of EaD4S from pZuFmEaD4S-1, pZuFmEaD4S-2, pZuFmEaD4S-3 were used to produce pZKL4-220EA4-1 (SEQ ID NO:378), pZKL4-220EA4-2 (SEQ ID NO:379) and pZKL4-220EA4-3 (SEQ ID NO:380) constructs. These three constructs were exactly the same as pZKL4-220EA4 (SEQ ID NO:362 and FIG. 52B, as described in Table 28 of Example 34), except that the coding region of EaD4S was truncated at the N-terminal region. Specifically, instead of the 583 amino acid long coding sequence of EaD4S (SEQ ID NO:193), the truncated EaD4S* polypeptide was 547 amino acids in length in pZKL4-220EA4-1 (i.e., SEQ ID NO:382), 527 amino acids in length in pZKL4-220EA4-2 (i.e., SEQ ID NO:384) and 512 amino acids in length in pZKL4-220EA4-3 (i.e., SEQ ID NO:386). The N-terminal region of these polypeptides (corresponding to amino acids 1-90 of SEQ ID NO:193) are aligned in FIG. 53A.

Plasmids pZKL4-220EA4 (SEQ ID NO:362), pZKL4-220EA4-1 (SEQ ID NO:378), pZKL4-220EA4-2 (SEQ ID NO:379) and pZKL4-220EA4-3 (SEQ ID NO:380) were digested with AscI/SphI, and then transformed into *Yarrowia lipolytica* strain Y4184U4, as described in the General Methods. Transformants were selected on MM plates. After 5 days growth at 30° C., 5 transformants grown on the MM plates from each construct were picked and re-streaked onto fresh MM plates. Once grown, these strains were individually inoculated into 3 mL liquid MM at 30° C. and shaken at 250 rpm/min for 2 days. The cells were collected by centrifugation, resuspended in HGM and then shaken at 250 rpm/min for 5 days. The cells were collected by centrifugation, lipids were extracted, and fatty acid methyl esters were prepared by trans-esterification, and subsequently analyzed with a Hewlett-Packard 6890 GC.

The GC results are shown below in Table 29. The composition of DPA and DHA are presented as a % of the total fatty acids. The conversion efficiency ("Conv. Effic.") was measured according to the following formula: ([DHA]/[DPA+DHA])*100. The delta-4 desaturase activity of each truncated EaD4S* (i.e., the polypeptides of 547 amino acids, 527 amino acids or 512 amino acids in *Yarrowia* transformants of pZKL4-220EA4-1, pZKL4-220EA4-2 and pZKL4-220EA4-3, respectively) was compared to that of EaD4S (i.e., *Yarrowia* transformants of pZKL4-220EA4) in the column labeled "% Delta-4 Activity".

TABLE 29

Functional Analysis Of EaD4S And Truncated Variants In *Yarrowia lipolytica* Strain Y4184U4

| Plasmid Transformant | Delta-4 Desaturase Length (SEQ ID NO) | DPA (%) | DHA (%) | Conv. Effic. (%) | % Delta-4 Activity |
|---|---|---|---|---|---|
| pZKL4-220EA4 (SEQ ID NO: 362) | 583 AA (SEQ ID NO: 193) | 10.2 | 0.4 | 4.2 | 100 |
| pZKL4-220EA4-1 (SEQ ID NO: 378) | 547 AA (SEQ ID NO: 382) | 8.0 | 2.2 | 21.5 | 512 |
| pZKL4-220EA4-2 (SEQ ID NO: 379) | 527 AA (SEQ ID NO: 384) | 11.5 | 1.8 | 13.2 | 314 |
| pZKL4-220EA4-3 (SEQ ID NO: 380) | 512 AA (SEQ ID NO: 386) | 11.0 | 1.3 | 10.4 | 248 |

These data demonstrated that the N-terminal 37 amino acids of EaD4S (i.e., amino acids 1-37 of SEQ ID NO:193) have a negative effect on the activity of the delta-4 desaturase. Elevated delta-4 desaturase activity is measured with respect to EaD4S in each of the EaD4S* truncated proteins, although the EaD4S* polypeptide of 547 amino acids (SEQ ID NO:382) is superior in activity as compared to the EaD4S* polypeptides lacking additional amino acids from their N-terminus (i.e., SEQ ID NOs:384 and 386).

Example 52

Synthesis and Functional Analysis of a Codon-Optimized Delta-4 Desaturase Gene (EqD4S) from *Euglena gracilis* in *Yarrowia lipolytica*

The codon usage of the delta-4 desaturase domain of EgDHAsyn1 (SEQ ID NO:221) of *Euglena gracilis* (corresponding to amino acids 253-793 of SEQ ID NO:12) was optimized for expression in *Yarrowia lipolytica*, in a manner similar to that described in PCT Publication No. WO 2004/101753, U.S. Pat. No. 7,125,672, and Examples 32, 33, and 34 herein. Specifically, a codon-optimized delta-4 desaturase gene (designated "EgD4S"; SEQ ID NO:387) was designed, based on the coding sequence of the delta-4 desaturase domain of EgDHAsyn1, according to the *Yarrowia* codon usage pattern (PCT Publication No. WO 2004/101753), the consensus sequence around the 'ATG' translation initiation codon, and the general rules of RNA stability (Guhaniyogi, G. and J. Brewer, Gene, 265(1-2):11-23 (2001)). In addition to the modification of the translation initiation site, 282 bp of the 1623 bp coding region were modified (17.4%) and 270 codons were optimized (49.9%). The codon-optimized coding region of EgD4S is 1623 bp in length, thereby encoding a polypeptide of 540 amino acids (SEQ ID NO:388). Thus, EgD4S is one amino acid shorter in length than the wildtype delta-4 desaturase domain of EgDHAsyn1 (i.e., SEQ ID NO:221; specifically, the leucine residue corresponding to amino acid position 2 of SEQ ID NO:13 was removed in EgD4S (SEQ ID NO:388). The designed EgD4S gene (SEQ ID NO:387) was synthesized by GenScript Corporation (Piscataway, N.J.) and cloned into pUC57 (GenBank Accession No. Y14837) to generate pEgD4S (SEQ ID NO:389).

To analyze the function of the codon-optimized EgD4S gene, plasmid pZKL4-220Eg4 (SEQ ID NO:390) was constructed to integrate two chimeric C20 elongase genes and the chimeric EgD4S gene into the lipase 4 like locus (GenBank Accession No. XM_503825) of *Yarrowia lipolytica* strain Y4305U3. Plasmid pZKL4-220Eg4 (SEQ ID NO:390) was identical in construction to that of plasmid pZKL4-220Ea4 (SEQ ID NO:362; FIG. 52B; Table 28 of Example 34), with the exception that EgD4S (SEQ ID NO:387) was used in place of EaD4S (SEQ ID NO:192).

Plasmid pZKL4-220Eg4 was digested with AscI/SphI, and then transformed into *Yarrowia lipolytica* strain Y4305U3, as described in the General Methods. The transformants were selected on MM plates. After 5 days growth at 30° C., 14 transformants grown on the MM plates were picked and re-streaked onto fresh MM plates. Once grown, these strains were individually inoculated into 3 mL liquid MM at 30° C. and shaken at 250 rpm/min for 2 days. The cells were collected by centrifugation, resuspended in HGM and then shaken at 250 rpm/min for 5 days. The cells were collected by centrifugation, lipids were extracted, and fatty acid methyl esters were prepared by trans-esterification, and subsequently analyzed with a Hewlett-Packard 6890 GC.

GC analyses showed that there were an average of 4.9% DHA and 17.8% DPA of total lipids produced in all 14 transformants, wherein the conversion efficiency of DPA to DHA was determined to be about 21.5% (calculated as described in Example 27). Thus, this experimental data demonstrated that the synthetic *Euglena gracilis* delta-4 desaturase codon-optimized for expression in *Yarrowia lipolytica* (i.e., EgD4S, as set forth in SEQ ID NO:387) was active to convert DPA to DHA.

Example 53

Determination of the Functional Domain in the Synthetic Delta-4 Desaturase Derived from *Euglena gracilis* and Codon-Optimized for Expression in *Yarrowia lipolytica* (EqD4S)

In a manner similar to that observed in EaDHAsyn1 (FIG. 52C), the C-terminal portion of the C20 elongase domain of EgDHAsyn1 appears to overlap with the N-terminal portion of the delta-4 desaturase domain of EgDHAsyn1, based on sequence comparison.

In order to define the functional delta-4 desaturase domain in EgD4S (SEQ ID NO:387), three EgD4S mutants with different N-terminal truncations were generated. A NcoI site was introduced into pEgD4S (SEQ ID NO:389; Example 52) by site-directed mutagenesis using primer pairs YL935 and YL936 (SEQ ID NOs:391 and 392, respectively), YL937 and YL938 (SEQ ID NOs:393 and 394, respectively) and YL939 and YL940 (SEQ ID NOs:395 and 396, respectively) to generate pEgD4S-M1 (SEQ ID NO:397), pEgD4S-M2 (SEQ ID NO:398) and pEgD4S-M3 (SEQ ID NO:399) constructs, respectively. The NcoI/NotI fragments containing different truncations of EgD4S from pEgD4S-M1, pEgD4S-M2 and pEgD4S-M3 were used to generate pZKL4-220Eg4-1 (SEQ ID NO:400), pZKL4-220Eg4-2 (SEQ ID NO:401) and pZKL4-EgD4-3 (SEQ ID NO:402) constructs. These three constructs were exactly the same as pZKL4-220Eg4 (SEQ ID NO:390; Example 52), except that the coding region of EgD4S was truncated at the N-terminal region. Specifically, instead of the 540 amino acid long coding sequence of EgD4S (SEQ ID NO:388), the truncated EgD4S* polypeptide was 513 amino acids in length in pZKL4-220Eg4-1 (i.e., SEQ ID NO:404), 490 amino acids in length in pZKL4-220Eg4-2 (i.e., SEQ ID NO:406) and 474 amino acids in length in pZKL4-220Eg4-3 (i.e., SEQ ID NO:408). The N-terminal region of these polypeptides (corresponding to amino acids 1-80 of SEQ ID NO:388) are aligned in FIG. 53B.

Plasmids pZKL4-220Eg4 (SEQ ID NO:390), pZKL4-220Eg4-1 (SEQ ID NO:400), pZKL4-220Eg4-2 (SEQ ID NO:401) and pZKL4-EgD4-3 (SEQ ID NO:402) were digested with AscI/SphI, and then transformed into *Yarrowia lipolytica* strain Y4305U3 individually, as described in the General Methods. Transformants were selected on MM plates. After 5 days growth at 30° C., 4 transformants grown on the MM plates from each construct were picked and re-streaked onto fresh MM plates. Once grown, these strains were individually inoculated into 3 mL liquid MM at 30° C. and shaken at 250 rpm/min for 2 days. The cells were collected by centrifugation, resuspended in HGM and then shaken at 250 rpm/min for 5 days. The cells were collected by centrifugation, lipids were extracted, and fatty acid methyl esters were prepared by trans-esterification, and subsequently analyzed with a Hewlett-Packard 6890 GC.

The GC results are shown below in Table 30. The composition of DPA and DHA are presented as a % of the total fatty acids. The conversion efficiency ("Conv. Effic.") was measured according to the following formula: ([DHA]/[DPA+ DHA])*100. The delta-4 desaturase activity of each truncated EgD4S* (i.e., the polypeptides of 513 amino acids, 490 amino acids or 474 amino acids in *Yarrowia* transformants of pZKL4-220Eg4-1, pZKL4-220Eg4-2 and pZKL4-220Eg4-3, respectively) was compared to that of EgD4S (i.e., *Yarrowia* transformants of pZKL4-220Eg4) in the column labeled "% Delta-4 Activity".

TABLE 30

Functional Analysis Of EgD4S And Truncated Variants In *Yarrowia lipolytica* Strain Y4305U3

| Plasmid Transformant | Delta-4 Desaturase Length (SEQ ID NO) | DPA (%) | DHA (%) | Conv. Effic. (%) | % Delta-4 Activity |
|---|---|---|---|---|---|
| pZKL4-220Eg4 (SEQ ID NO: 390) | 540 AA (SEQ ID NO: 388) | 17.8 | 4.9 | 21.5 | 100 |
| pZKL4-220Eg4-1 (SEQ ID NO: 400) | 513 AA (SEQ ID NO: 404) | 16.5 | 4.6 | 21.6 | 100 |
| pZKL4-220Eg4-2 (SEQ ID NO: 401) | 490 AA (SEQ ID NO: 406) | 16.8 | 3.8 | 18.5 | 86 |
| pZKL4-220Eg4-3 (SEQ ID NO: 402) | 474 AA (SEQ ID NO: 408) | 24.7 | 2.4 | 8.8 | 41 |

These data demonstrated that the N-terminal 28 amino acids of EgD4S* are dispensable (i.e., see pZKL4-220Eg4-1, where the first 28 amino acids of EgD4S were truncated and the truncated protein set forth as SEQ ID NO:404 retained full delta-4 desaturase activity). Reduced delta-4 desaturase activity was measured in transformants with pZKL4-220EgD4-2 and pZKL4-220EgD4-3, when additional amino acids were truncated from the 5' portion of the EgD4S protein, thereby resulting in SEQ ID NO:406 and SEQ ID NO:408.

Example 54

Synthesis and Functional Analysis of a Codon-Optimized EgDHAsyn1 Gene (EgDHAsvn1S) from *Euglena gracilis* in *Yarrowia lipolytica*

Plasmid pZKLY-G204 (FIG. 54A; SEQ ID NO:409) was designed to integrate a chimeric gene containing a codon-optimized EgDHAsyn1 coding region (i.e., EgDHAsyn1 S, set forth as SEQ ID NOs:410 and 411) into the lipase 7 locus (GenBank Accession No. AJ549519) of *Yarrowia lipolytica* strain Y4305U3. In addition to the modification of the translation initiation site, 417 bp of the 2382 bp coding region were modified (17.5%), and 391 codons of the total 794 codons were optimized (49.2%). The amino acid sequence of the codon-optimized EgDHAsyn1S (SEQ ID NO:411) is 100% identical in sequence to that of EgDHAsyn1 (SEQ ID NO:12).

To generate pZKLY-G204, a KpnI site was introduced into pEgC20ES (SEQ ID NO:185; see FIG. 51B, Example 32) to generate pEgC20ES-K (SEQ ID NO:412; FIG. 54B) by site-directed mutagenesis using oligonucleotides YL973 and YL974 (SEQ ID NOs:413 and 414, respectively) as primers and pEgC20ES as template. A 732 bp PmeI/NcoI fragment containing the YAT1 promoter (Patent Publication US 2006/ 0094102-A1) of pYNTGUS1-CNP (FIG. 54C; SEQ ID NO:415), the 873 bp NcoI/KpnI fragment of pEgC20ES-K containing the codon-optimized N-terminal portion of EgDHAsyn1S and the 1512 bp KpnI/NcoI fragment of pEgD4S (SEQ ID NO:389; Example 52) containing the codon-optimized C-terminal portion of EgDHAsyn1S were isolated, and then used to replace the PmeI/NotI fragment of pZKLY (FIG. 54D; SEQ ID NO:416) to generate pZKLY-G204 (FIG. 54A). Thus, pZKLY-G204 contained the following components:

TABLE 31

Components Of Plasmid pZKLY-G204 (SEQ ID NO: 409)

| RE Sites And Nucleotides Within SEQ ID NO: 409 | Description Of Fragment And Chimeric Gene Components |
|---|---|
| Asc I/BsiW I (1383-489) | 887 bp 5' portion of the *Yarrowia Lipase* 7 gene (SEQ ID NO: 417) (labeled as "LipY-5'" in Figure; GenBank Accession No. AJ549519) |
| PacI/SphI (4853-4091) | 756 bp 3' portion of *Yarrowia Lipase* 7 gene (SEQ ID NO: 417) (labeled as "LipY-3'" in Figure; GenBank Accession No. AJ549519) |
| Pme I/BsiW I (7301-333) | YAT1::EgDHAsyn1S::Lip1, comprising: YAT1: *Yarrowia lipolytica* YAT1 promoter (Patent Publication No. US 2006/0094102-A1); EgDHAsyn1S: codon-optimized DHA synthase (SEQ ID NO: 410), derived from *Euglena gracilis*; Lip1: Lip1 terminator sequence from *Yarrowia* Lip1 gene (GenBank Accession No. Z50020) |
| SaI I/EcoR I (6504-4885) | *Yarrowia* Ura3 gene (GenBank Accession No. AJ306421) |

The pZKLY-G204 plasmid was digested with AscI/SphI, and then transformed into *Yarrowia lipolytica* strain Y4305U3, as described in the General Methods. The transformants were selected on MM plates. After 5 days growth at 30° C., 8 transformants grown on the MM plates were picked and re-streaked onto fresh MM plates. Once grown, these strains were individually inoculated into 3 mL liquid MM at 30° C. and shaken at 250 rpm/min for 2 days. The cells were collected by centrifugation, resuspended in HGM and then shaken at 250 rpm/min for 5 days. The cells were collected by centrifugation, lipids were extracted, and fatty acid methyl esters were prepared by trans-esterification, and subsequently analyzed with a Hewlett-Packard 6890 GC.

GC analyses showed that there were about 5.0% DHA, 13.5% DPA and 26.5% EPA of total lipids produced in all 8 transformants. The conversion efficiency of EPA to DPA and DHA was determined to be about 41%; and, the conversion efficiency of DPA to DHA was determined to be about 27% in these eight strains (calculated as described in Example 27). Thus, this experimental data demonstrated that the synthetic *Euglena gracilis* DHA synthase codon-optimized for expression in *Yarrowia lipolytica* (i.e., EgDHAsyn1S as set forth in SEQ ID NO:410) contained both C20 elongase activity and delta-4 desaturase activity. EgDHAsyn1S could use EPA as substrate to produce DHA.

Example 55

Creation of Delta-9 Elongase/Delta-8 Desaturase Gene Fusions for Expression in *Yarrowia lipolytica*

In order to improve the enzyme activity of delta-9 elongase and delta-8 desaturase in *Yarrowia lipolytica*, a series of six delta-9 elongase/delta-8 desaturase gene fusions (multizymes) are created in the present Example, using two variant linker sequences (i.e., SEQ ID NO:438 [GPARPAGLPPATYYD-SLAV] and SEQ ID NO:445 [GAGPARPAGLPPATYYD- SLAVMGS]) derived from the EgDHAsyn1 proline-rich linker (SEQ ID NO:198; PARPAGLPPATYYDSLAV).

This work required: identification of appropriate delta-9 elongases and delta-8 desaturases for expression in *Yarrowia lipolytica*; and, construction of plasmid pZUFmG9G8fu (comprising a EgD9ES/EgD8M gene fusion), plasmid pZuFmG9G8fu-B (comprising a EgD9ES/EgD8M gene fusion), plasmid pZUFmG9A8 (comprising a EgD9ES/EaD8S gene fusion), plasmid pZUFmA9G8 (comprising a EaD9ES/EgD8M gene fusion), plasmid pZUFmA9A8 (comprising a EaD9ES/EaD8S gene fusion) and plasmid pZUFmR9G8 (comprising a E389D9eS/EgD8M gene fusion). All plasmids shared a common vector backbone and thus were distinguished only by the gene fusion that each comprised.

Functional analysis of the activity of each gene fusion is tested infra, in Example 56.

Description of Synthetic Delta-9 Elongase and Delta-8 Desaturase Genes Codon-Optimized for Expression in *Yarrowia lipolytica*

The Applicants have performed considerable analyses of various delta-9 elongases and delta-8 desaturases, to determine those enzymes having optimal substrate specificity and/or substrate selectivity when expressed in *Yarrowia lipolytica*. Based on these analyses, the genes described below in Table 32, and codon-optimized genes derived there from (based on methodology of U.S. Pat. No. 7,125,672), were identified as preferred for expression in *Y. lipolytica*. Those genes highlighted in bold text were subsequently utilized to create delta-9 elongase/delta-8 desaturase gene fusions.

(12%). All synthetic codon-optimized genes functioned with greater substrate conversion efficiency than the corresponding wildtype gene.

U.S. Pat. No. 7,256,033 discloses a E. gracilis delta-8 desaturase ("EgD8") able to desaturate EDA and EtrA to DGLA and ETA, respectively, as well as a synthetic delta-8 desaturase derived from EgD8 and codon-optimized for expression in *Yarrowia lipolytica* ("EgD8S"). Despite the usefulness of EgD8 and EgD8S, a synthetically engineered mutant delta-8 desaturase identified herein as EgD8M (SEQ ID NOs:327 and 328) is used in more preferred embodiments for expression in *Yarrowia lipolytica*. As described in U.S. patent application Ser. No. 11/635,258, "EgD8M" (identified therein as "EgD8S-23") was created by making multiple rounds of targeted mutations within EgD8S. The effect of each mutation on the delta-8 desaturase activity of the resulting mutant was screened to ensure functional equivalence with the delta-8 desaturase activity of EgD8S (SEQ ID NO:426). As a result of this work, mutant EgD8M (SEQ ID NO:328) comprises the following 24 amino acid mutations with respect to the synthetic codon-optimized EgD8S sequence set forth as SEQ ID NO:426: 4S to A, 5K to S, 12T to V, 16T to K, 17T to V, 66P to Q, 67S to A, 108S to L, 117G to A, 118Y to F, 120 L to M, 121M to L, 125Q to H, 126M to L, 132V to L, 133 L to V, 162 L to V, 163V to L, 293 L to M, 407A to S, 408V to Q, 418A to G, 419G to A and 422 L to Q. Pairwise alignment of the EgD8M and EgD8S protein sequences using default parameters of Vector NTI®'s AlignX program (Invitrogen Corporation, Carlsbad, Calif.) revealed 94.3% sequence identity and 97.9% consensus between the

TABLE 32

Preferred Desaturases And Elongases For Creation Of Delta-9/Delta-8 Gene Fusions In *Yarrowia lipolytica*

| ORF | Organism | Co-pending Patent Application References | Wildtype Abbreviation and SEQ ID NOs | Codon-Optimized Abbreviation and SEQ ID NOs | Mutant Abbreviation and SEQ ID NO |
|---|---|---|---|---|---|
| Delta-9 Elongase | *Euglena gracilis* | Patent Publication US 2007-0117190 A1; see also Example 16 herein | "EgD9e"* (SEQ ID NO: 112) | "EgD9eS" (SEQ ID NOs: 318 and 319) | — |
| | *Eutreptiella sp. CCMP389* | Patent Publication US 2007-0117190 A1; | "E389D9e" (SEQ ID NOs: 419 and 420) | "E389D9eS" (SEQ ID NOs: 358 and 359) | — |
| | *Euglena anabaena* UTEX 373 | Example 36 herein | "EaD9e"* (SEQ ID NOs: 252 and 254) | "EaD9eS" (SEQ ID NOs: 421 and 422) | — |
| Delta-8 Desaturase | *Euglena gracilis* | U.S. Pat. No. 7,256,033; U.S. Patent Application No. 11/635258 | "EgD8"* (SEQ ID NOs: 423 and 424) | "EgD8S"* (SEQ ID NOs: 425 and 426) | "EgD8M"* (SEQ ID NOs: 327 and 328) |
| | *Euglena anabaena* UTEX 373 | | "EaD8"* (SEQ ID NOs: 427 and 428) | "EaD8S" (SEQ ID NOs: 429 and 430) | — |

*Notes:
EgD9e was described as "EgD9elo" in Example 16 herein.
EaD9e was identified as "EaD9Elo1" in U.S. Provisional Patent Application No. 60/911925 and in Example 36, herein.
EgD8 was identified as "Eg5" in U.S. Pat. No. 7,256,033.
EgD8S was identified as "D8SF" in U.S. Pat. No. 7,256,033.
EgD8M was identified as "EgD8S-23" in U.S. Patent Application No. 11/635258.

The LA to EDA conversion efficiency of EgD9eS, E389D9eS and EaD9eS is reported in each of the applications cited above. Briefly, however, when each delta-9 elongase was expressed as a chimeric gene in *Yarrowia lipolytica* strain Y2224 (FIG. 44), under the control of a *Yarrowia* FBAINm promoter (PCT Publication No. WO 2005/049805; U.S. Pat. No. 7,202,356) and a Pex20 terminator sequence from the *Yarrowia* Pex20 gene (GenBank Accession No. AF054613), the following substrate conversions were independently measured: EgD9eS (20.1%); EaD9eS (13%); and, E389D9eS two proteins over a length of 422 amino acids. Average EDA to DGLA substrate conversion by this mutant delta-8 desaturase was determined to be 37%, when EgD8M was expressed in *Yarrowia lipolytica* strain Y4001 (FIG. 44), under the control of a *Yarrowia* FBAINm promoter (PCT Publication No. WO 2005/049805; U.S. Pat. No. 7,202,356) and a Pex20 terminator sequence from the *Yarrowia* Pex20 gene (GenBank Accession No. AF054613).

When EaD8S was expressed in *Yarrowia lipolytica* strain Y4001U (FIG. 44), under the control of a *Yarrowia* FBAINm promoter U.S. Pat. No. 7,202,356) and a Pex20 terminator sequence from the *Yarrowia* Pex20 gene (GenBank Accession No. AF054613), there was 41% conversion efficiency to DGLA with endogenous EDA as substrate.

Generation of Construct pZUFmEgD9ES-Na, Comprising EgD9ES

Plasmid pZuFmEgD9ES (SEQ ID NO:431), which was previously described in Patent Publication US 2007-0117190 A1, comprises a chimeric FBAINm::EgD9ES::Pex20 gene, a ColE1 plasmid origin of replication, an ampicillin-resistance gene (Amp$^R$) for selection in *E. coli*, a *Yarrowia* autonomous replication sequence (ARS18; GenBank Accession No. A17608), and a *Yarrowia* Ura 3 gene (GenBank Accession No. AJ306421).

A Nar I site was introduced into pZuFmEgD9ES to generate pZuFmEgD9ES-Na (SEQ ID NO:432) using oligonucleotides YL989 and YL990 (SEQ ID NOs:433 and 434, respectively) as primers and pZuFmEgD9ES as template. The introduced Nar I site (i.e., GGCGCC) was located just before the translation stop codon of EgD9ES; therefore, the coding region of EgD9ES was extended with two additional amino acids (i.e., a glycine and an alanine).

Generation of Construct pZUFmG9G8fu, Comprising a EqD9ES/EqD8M Gene Fusion

The N-terminal portion of EgD8M (SEQ ID NO:327) was amplified by PCR using oligonucleotides YL991 and YL992 (SEQ ID NOs:435 and 436, respectively) as primers and pKO2UFm8A (SEQ ID NO:437) as template. Oligonucleotide YL991 contained a Nar I site at its 5' end and DNA sequence encoding a modified variant of the EgDHAsyn1 proline-rich linker (i.e., <u>G</u>PARPAGLPPATYYDSLAV, as set forth in SEQ ID NO:438 versus PARPAGLPPATYYDSLAV, as set forth in SEQ ID NO:198). This linker possessed an additional glycine at the 5' end, with respect to the EgDHAsyn1 proline-rich linker (SEQ ID NO:198).

The Nar I/Bgl II digested PCR product comprising the 5' portion of EgD8M and the Bgl II/Not I digested fragment of pKO2UFm8A comprising the 3' portion of EgD8M was used to replace the Nar I/Not I fragment of pZuFmEgD9ES-Na to generate pZUFmG9G8fu (FIG. 55A), which thereby contained the following components:

TABLE 33

Components Of Plasmid pZUFmG9G8fu (SEQ ID NO: 439)

| RE Sites And Nucleotides Within SEQ ID NO: 439 | Description Of Fragment And Chimeric Gene Components |
|---|---|
| Swa I/BsiW I (6067-318) | FBAINm::EgD9ES/EgD8M::Pex20, comprising: FBAINm: *Yarrowia lipolytica* FBAINm promoter (WO 2005/049805; U.S. Pat. No. 7,202,356); EgD9ES/EgD8M: gene fusion comprising the codon-optimized *Euglena gracilis* delta-9 elongase (EgD9ES), a modified linker derived from EgDHAsyn1, and the synthetic mutant delta-8 desaturase derived from *Euglena gracilis* (EgD8M) (EgD8M is labeled as "EgD8-23" in the Figure) (nucleotide sequence of full-length gene fusion is set forth as SEQ ID NO: 440, while the translated amino acid sequence is set forth as SEQ ID NO: 441); Pex20: Pex20 terminator sequence of *Yarrowia* Pex20 gene (GenBank Accession No. AF054613); |
| 1354-474 | ColE1 plasmid origin of replication |
| 2284-1424 | ampicillin-resistance gene (Amp$^R$) for selection in *E. coli* |
| 3183-4487 | *Yarrowia* autonomous replication sequence (ARS18; GenBank Accession No. A17608) |
| 6020-4533 | *Yarrowia* Ura 3 gene (GenBank Accession No. AJ306421) |

Generation of Construct pZuFmG9G8fu-B, Comprising a EgD9ES/EgD8M Gene Fusion

A BamH I site (i.e., GGATCC) was introduced into pZUFmG9G8fu to generate pZUFmG9G8fu-B (SEQ ID NO:442) using oligonucleotides YL1043 and YL1044 (SEQ ID NOs:443 and 444, respectively) as primers and pZuFmG9G8fu as template. The BamH I site was located just after the translation start codon ATG and was in the reading frame of EgD8M, which resulted in a two amino acid insertion (i.e., glycine and serine) between the methionine amino acid residue and the remaining portion of the EgD8M polypeptide. This modification caused the linker region between EgD9ES and EgD8M to become a peptide having the sequence set forth as SEQ ID NO:445 (i.e., GAGPARPAGLPPATYYDSLAVMGS); the nucleotide and translated amino acid sequence of the full-length EgD9ES/EgD8M gene fusion is set forth as SEQ ID NOs:446 and 447, respectively.

Generation of Construct pZUFmG9A8, Comprising a EqD9ES/EaD8S Gene Fusion

Plasmid pEaD8S (SEQ ID NO:448) was created when the EaD8S gene (SEQ ID NO:429) was cloned into pUC57 (GenBank Accession No. Y14837). Then, a BamH I site was introduced into pEaD8S using oligonucleotides YL1059 and YL1060 (SEQ ID NOs:449 and 450, respectively) as primers and pEaD8S as template, to generate pEaD8S-B (SEQ ID NO:451). The introduced BamH I site (i.e., GGATCC) was located just before the translation start codon of EaD8S in pEaD8S-B, and is in the same reading frame with EaD8S.

The BamH I/Not I fragment of pEaD8S-B comprising EaD8S was used to replace the BamH I/Not I fragment of pZUFmG9G8fu-B (SEQ ID NO:442) to generate pZUFmG9A8 (SEQ ID NO:452; FIG. 55B) (thereby introducing EaD8S in place of EgD8M). The linker region between EgD9ES and EaD8S was a peptide having the sequence set forth in SEQ ID NO:445 (i.e., GAGPARPAGLPPATYYDSLAVMGS). Thus, plasmid pZUFmG9A8 contained the EgD9ES/EaD8S gene fusion, flanked by the *Yarrowia lipolytica* FBAINm promoter and a Pex20 terminator (GenBank Accession No. AF054613). The nucleotide and translated amino acid sequence of the full-length EgD9ES/EaD8S gene fusion is set forth as SEQ ID NOs:453 and 454, respectively.

Generation of Construct pZUFmA9G8, Comprising a EaD9ES/EgD8M Gene Fusion

Plasmid pZUFmEaD9ES (SEQ ID NO:455) contained the EaD9ES gene, flanked by the *Yarrowia lipolytica* FBAINm promoter and a Pex20 terminator (GenBank Accession No. AF054613). A Nar I site was introduced into the plasmid to generate pZUFmEaD9ES-Na (SEQ ID NO:456) using oligonucleotides YL1049 and YL1050 (SEQ ID NOs:457 and 458, respectively) as primers and pZUFmEaD9ES as template. The introduced Nar I site (i.e., GGCGCC) was located just before the translation stop codon of EaD9ES, and is in the same reading frame of EaD9ES.

The Nco I/Nar I fragment of pZUFmEaD9ES-Na (SEQ ID NO:456) comprising EaD9ES was used to replace the Nco I/Nar I fragment of pZUFmG9G8fu-B (SEQ ID NO:442) to generate pZUFmA9G8 (SEQ ID NO:459) (thereby introducing EaD9ES in place of EgD9ES). The linker region between EaD9ES and EgD8M was a peptide having the sequence set forth in SEQ ID NO:445 (i.e., GAGPARPAGLPPATYYDSLAVMGS). Thus, plasmid pZUFmA9G8 contained the EaD9ES/EgD8M gene fusion, flanked by the *Yarrowia lipolytica* FBAINm promoter and a Pex20 terminator (GenBank Accession No. AF054613). The nucleotide and translated amino acid sequence of the full-length EaD9ES/EgD8M gene fusion is set forth as SEQ ID NOs:460 and 461, respectively.

Generation of Construct pZUFmA9A8, Comprising a EaD9ES/EaD8S Gene Fusion

The BamH I/Not I fragment of pEaD8S-B (SEQ ID NO:451) comprising EaD8S was used to replace the BamH I/Not I fragment of pZUFmA9G8 (SEQ ID NO:459) to generate pZUFmA9A8 (SEQ ID NO:462) (thereby introducing EaD8S in place of EgD8M). The linker region between EaD9ES and EaD8S was a peptide having the sequence set forth in SEQ ID NO:445 (i.e., GAGPARPAGLPPATYYD-SLAVMGS). Thus, plasmid pZUFmA9A8 contained the EaD9ES/EaD8S gene fusion, flanked by the *Yarrowia lipolytica* FBAINm promoter and a Pex20 terminator (GenBank Accession No. AF054613). The nucleotide and translated amino acid sequence of the full-length EaD9ES/EaD8S gene fusion is set forth as SEQ ID NOs:463 and 464, respectively.

Generation of Construct pZUFmR9G8, Comprising a E389D9eS/EgD8M Gene Fusion

Plasmid pE389S (SEQ ID NO:465) was created when the E389D9eS gene (SEQ ID NO:358) was cloned into pUC57 (GenBank Accession No. Y14837). Then, a NarI site was introduced into pE389S to generate pE389S-Na (SEQ ID NO:466) using oligonucleotides YL1051 and YL1052 (SEQ ID NOs:467 and 468, respectively) as primers and pE389S as template. The introduced Nar I (i.e., GGCGCC) site was located just before the translation stop codon and was in the same reading frame of E389D9eS.

The Nco I/Nar I fragment of pE389S-Na comprising E389D9eS was used to replace the Nco I/Nar I fragment of pZUFmG9G8fu-B comprising EgD9ES to generate pZUFmR9G8 (SEQ ID NO:469) (thereby introducing E389D9eS in place of EgD9ES). The linker region between E389D9eS and EgD8M was a peptide having the sequence set forth in SEQ ID NO:445 (i.e., GAGPARPAGLPPATYYD-SLAVMGS). Thus, plasmid pZUFmR9G8 contained the E389D9eS/EgD8M gene fusion, flanked by the *Yarrowia lipolytica* FBAINm promoter and a Pex20 terminator (GenBank Accession No. AF054613). The nucleotide and trans-lated amino acid sequence of the full-length E389D9eS/EgD8M gene fusion is set forth as SEQ ID NOs:470 and 471, respectively.

Example 56

Functional Analyses of Delta-9 Elongase/Delta-8 Desaturase Gene Fusions in *Yarrowia lipolytica* Strain Y2224

The plasmids from Example 55 [i.e., pZUFmEgD9ES (SEQ ID NO:431), pZUFMEgD9ES-Na (SEQ ID NO:432), pZUFMG9G8fu (SEQ ID NO:439), pZUFmG9G8fu-B (SEQ ID NO:442), pZUFmG9A8 (SEQ ID NO:452), pZUFmA9G8 (SEQ ID NO:459), pZuFmA9A8 (SEQ ID NO:462) and pZUFmR9G8 (SEQ ID NO:469)] were transformed into *Yarrowia lipolytica* strain Y2224 individually, as described in the General Methods. The transformants were selected on MM plates. After 2 days growth at 30° C., eight transformants from each transformation reaction were streaked out onto new MM plates and incubated for an additional 2 days at 30° C. Once grown, these strains were individually inoculated into 3 mL liquid MM at 30° C. and shaken at 250 rpm/min for 2 days. The cells were collected by centrifugation, the supernatant was removed and 3 mL of HGM was added. These strains were grown in a 30° C. incubator shaking at 250 rpm for an additional 5 days. The cells were collected by centrifugation, lipids were extracted, and fatty acid methyl esters were prepared by trans-esterification, and subsequently analyzed with a Hewlett-Packard 6890 GC.

GC analyses showed that there were both delta-9 elongase and delta-8 desaturase activities in all strains having a delta-9 elongase/delta-8 desaturase gene fusion. The results are summarized below in Table 34. Delta-9 elongase activity was calculated by dividing the sum of the weight percent (wt %) for EDA and DGLA by the sum of the wt % for LA, EDA and DGLA and multiplying by 100 to express as a percent; similarly, delta-8 desaturase activity was calculated by dividing the wt % for DGLA by the sum of the wt % for EDA and DGLA and multiplying by 100 to express as a percent.

TABLE 34

| Y2224 Transformant (plasmid nucleotide SEQ ID NO) | Delta-9 Elongase (amino acid SEQ ID NO) | Delta-8 Desaturase (amino acid SEQ ID NO) | Linker (amino acid SEQ ID NO) | Delta-9 Elongase Activity | Delta-8 Desaturase Activity |
|---|---|---|---|---|---|
| pZUFmEgD9ES (SEQ ID NO: 431) | EgD9ES (SEQ ID NO: 319) | — | — | 20% | — |
| pZUFmEgD9ES-Na (SEQ ID NO: 432) | EgD9ES (SEQ ID NO: 319) | — | — | 19% | — |
| pZUFmG9G8fu (SEQ ID NO: 439) | EgD9ES (SEQ ID NO: 319) | EgD8M (SEQ ID NO: 328) | GAGPARPAGLPPATYYDSLAVM (SEQ ID NO: 438) | 17% | 73% |
| pZUFmG9G8fu-B (SEQ ID NO: 442) | EgD9ES (SEQ ID NO: 319) | EgD8M (SEQ ID NO: 328) | GAGPARPAGLPPATYYDSLAVMGS (SEQ ID NO: 445) | 21% | 73% |
| pZUFmG9A8 (SEQ ID NO: 452) | EgD9ES (SEQ ID NO: 319) | EaD8S (SEQ ID NO: 430) | GAGPARPAGLPPATYYDSLAVMGS (SEQ ID NO: 445) | 21% | 67% |
| pZuFmA9G8 (SEQ ID NO: 459) | EaD9ES (SEQ ID NO: 422) | EgD8M (SEQ ID NO: 328) | GAGPARPAGLPPATYYDSLAVMGS (SEQ ID NO: 445) | 15% | 54% |
| pZUFmA9A8 (SEQ ID NO: 462) | EaD9ES (SEQ ID NO: 422) | EaD8S (SEQ ID NO: 430) | GAGPARPAGLPPATYYDSLAVMGS (SEQ ID NO: 445) | 18% | 58% |

TABLE 34-continued

| Y2224 Transformant (plasmid nucleotide SEQ ID NO) | Delta-9 Elongase (amino acid SEQ ID NO) | Delta-8 Desaturase (amino acid SEQ ID NO) | Linker (amino acid SEQ ID NO) | Delta-9 Elongase Activity | Delta-8 Desaturase Activity |
|---|---|---|---|---|---|
| pZUFmR9G8 (SEQ ID NO: 469) | E389D9eS (SEQ ID NO: 359) | EgD8M (SEQ ID NO: 328) | GAGPARPAGLPPATYYDSLAVMGS (SEQ ID NO: 445) | 18% | 70% |

Delta-9 Elongase and Delta-8 Desaturase Activities in *Yarrowia* Transformed with Various Gene Fusions In summary of Table 34, the data showed that all six fusion genes had both delta-9 elongase and delta-8 desaturase activities; thus, the fusion proteins from the fusion genes effectively permitted expression of two independent and separable enzymatic activities. More importantly, fusing the two independent enzymes together as one fusion protein separated by a linker region increased flux from LA to DGLA. In all cases, the fusion gene had higher activity than at least one of the individual genes when expressed alone in *Yarrowia*. These data suggested that the product of delta-9 elongase may be directly channeled as substrate of delta-8 desaturase in the fusion protein.

More specifically, in the case of the EgD9ES/EgD8M gene fusion (i.e., pZuFmG9G8fu-B) and the EgD9ES/EaD8S gene fusion (i.e., pZuFmG9A8), the EgD9ES delta-9 elongase (21% conversion) performed in a manner comparable to that when EgD9ES was expressed alone (20% conversion [pZuFmEgD9ES data and Example 55]). In contrast, however, the EgD8M delta-8 desaturase activity in *Yarrowia* expressing pZuFmG9G8-B was about 97% more efficient than when EgD8M was expressed alone (73% versus 37% conversion [Example 55]). Similarly, the EaD8S delta-8 desaturase activity in *Yarrowia* expressing pZuFmG9A8 was about 63% more efficient than when EaD8S was expressed alone (67% versus 41% conversion [Example 55]).

In the case of the EaD9ES/EgD8M gene fusion (i.e., pZuFmA9G8) and the EaD9ES/EaD8S gene fusion (i.e., pZuFmA9A8), the EaD9ES delta-9 elongase activity was about 15% and 38% more efficient, respectively, than when EaD9ES was expressed alone (15% and 18% conversion, respectively, versus 13% conversion [Example 55]). Likewise, the EgD8M delta-8 desaturase activity in *Yarrowia* expressing pZuFmA9G8 was about 46% more efficient than when EgD8M was expressed alone (54% versus 37% conversion [Example 55]). Similarly, the EaD8S delta-8 desaturase activity in *Yarrowia* expressing pZuFmA9A8 was about 32% more efficient than when EaD8S was expressed alone (58% versus 41% conversion [Example 55]).

Finally, in the case of the E389D9eS/EgD8M gene fusion (i.e., pZuFmR9G8), the E389D9eS delta-9 elongase activity was about 50% more efficient than when E389D9eS was expressed alone (18% versus 12% conversion [Example 55]). Likewise, the EgD8M delta-8 desaturase activity in *Yarrowia* expressing pZuFmR9G8 was about 89% more efficient than when EgD8M was expressed alone (70% versus 37% conversion [Example 55]).

Table 34 also demonstrated that the modified linker GAGPARPAGLPPATYYDSLAVMGS (SEQ ID NO:445) was preferred as opposed to the linker set forth as SEQ ID NO:438 in *Yarrowia lipolytica*, when fusing delta-9 elongase and delta-8 desaturase genes together.

It will be obvious to one of skill in the art that other PUFA desaturase and elongase genes that are preferred for expression in *Yarrowia lipolytica* (including, for example, any of those genes described in Tables 8-19) can be fused together in a manner similar to that described above and expressed in *Yarrowia lipolytica*. Preferred promoters and terminators suitable for construction of an expression cassette (wherein the ORF expressed encodes a multizyme) may be selected from those described in Tables 8-19. It is hypothesized that increased efficiency or flux would be observed in the fusion gene as opposed to when either (or both) individual genes are expressed alone.

Example 57

Creation of Delta-9 Elongase/Delta-8 Desaturase Gene Fusions for Expression in Soy In order to characterize multizyme fusions between delta-9 elongases and delta-8 desaturases in soy, a series of delta-9 elongase/delta-8 multizymes were created. Delta-9 elongase and delta-8 desaturase domains were separated by the EgDHAsyn1 proline-rich linker (SEQ ID NO:198). For comparison, constructs that co-expressed individual delta-9 elongase and delta-8 desaturase genes were also created. Delta-9 elongases used include EgD9elo (Example 16; SEQ ID NO:112; also referred to as EgD9e and EgD9E herein, but they are identical) and EaD9elo1 (SEQ ID NO:252; Example 36; also referred to as EaD9E and EaD9e herein, but they are all identical). Delta-8 desaturases used include TpomD8 (SEQ ID NO:162; Example 21) and the *Euglena anabaena* delta-8 desaturase (EaD8Des3; SEQ ID NO:427; also referred to as EaD8 but they are identical; described in U.S. Provisional Application No. 60/910,831 (filed Apr. 10, 2007).

In the present Example and for Example 23, which describes the synthesis of the EgD9elo-EgDHAsyn1 Link-PavD8 fusion, additional nucleotides were added to the 3' end of the EgDHAsyn1 proline-rich linker sequence to enable cloning when making the fusions for all constructs. Thus, an additional 4 amino acids were included between the end of the EgDHAsyn1 proline-rich linker (SEQ ID NO:198; PARPAGLPPATYYDSLAV) and the start of the delta-8 desaturase used (i.e. SEQ ID NO:472; PARPAGLPPATYYDSLAVSGRT).

Plasmid pKR1183 (SEQ ID NO:266) comprising the *Euglena anabaena* delta-9 elongase-Tetruetreptia pomquetensis CCMP1491 delta-8 desaturase fusion (Hybrid1-HGLA Synthase; also called EaD9e/TpomD8) was described in Example 38.

Other plasmids described in the present example include: pKR1014 (described in U.S. patent application Ser. No. 11/876,115 (filed Oct. 22, 2007; comprising EgD9e and TpomD8 expressed individually), pKR1152 (comprising an EgD9e and EaD8 expressed individually), pKR1151 (comprising an EaD9e and TpomD8 expressed individually), pKR1150 (comprising an EaD9e and EaD8 expressed individually), pKR1184 (comprising a EaD9e/EaD8 gene fusion), pKR1199 (comprising a EgD9e/TpomD8 gene fusion), and pKR1200 (comprising a EgD9e/EaD8 gene fusion). A summary of the constructs made and respective genes tested along with the SEQ ID NOs for the nucleotide and amino acid sequences produced is shown in Table 35.

Functional analysis of the activity of each gene fusion is tested infra, in Example 60.

TABLE 35

Preferred Desaturases And Elongases For Creation Of Delta-9/Delta-8 Gene Fusions In Soy

| Vector | Vector SEQ ID NOs | Gene(s) Expressed | SEQ ID NOs for nucleotide sequence(s) | SEQ ID NOs for amino acid sequences |
|---|---|---|---|---|
| pKR1014 | SEQ ID NO: 474 | EgD9e | SEQ ID NO: 112 | SEQ ID NO: 513 |
|  |  | TpomD8 | SEQ ID NO: 162 | SEQ ID NO: 514 |
| pKR1152 | SEQ ID NO: 479 | EgD9e | SEQ ID NO: 112 | SEQ ID NO: 513 |
|  |  | EaD8 | SEQ ID NO: 427 | SEQ ID NO: 428 |
| pKR1151 | SEQ ID NO: 484 | EaD9e | SEQ ID NO: 252 | SEQ ID NO: 254 |
|  |  | TpomD8 | SEQ ID NO: 162 | SEQ ID NO: 514 |
| pKR1150 | SEQ ID NO: 485 | EaD9e | SEQ ID NO: 252 | SEQ ID NO: 254 |
|  |  | EaD8 | SEQ ID NO: 427 | SEQ ID NO: 428 |
| pKR1199 | SEQ ID NO: 488 | EgD9e/TpomD8 fusion | SEQ ID NO: 492 | SEQ ID NO: 515 |
| pKR1200 | SEQ ID NO: 490 | EgD9e/EaD8 fusion | SEQ ID NO: 493 | SEQ ID NO: 516 |
| pKR1183 | SEQ ID NO: 266 | EaD9e/TpomD8 fusion | SEQ ID NO: 494 | SEQ ID NO: 517 |
| pKR1184 | SEQ ID NO: 491 | EaD9e/EaD8 fusion | SEQ ID NO: 495 | SEQ ID NO: 518 |
| KS373 | SEQ ID NO: 179 | EgD9e/PavD8 fusion | SEQ ID NO: 496 | SEQ ID NO: 519 |

Construction of pKR1014

Vector pKR123r, which was previously described in PCT Publication No. WO 2004/071467 (published Aug. 26, 2004), contains a NotI site flanked by the Kunitz soybean Trypsin Inhibitor (KTi3) promoter (Jofuku et al., *Plant Cell* 1:1079-1093 (1989)) and the KTi 3' termination region, the isolation of which is described in U.S. Pat. No. 6,372,965 (KTi3/NotI/KTi3' cassette). TpomD8 (SEQ ID NO:162; Example 21) was released from pLF114-10 (SEQ ID NO:165; Example 21) by digestion with NotI and cloned into the NotI site of pKR123r to produce pKR1007 (SEQ ID NO:473).

Vector pKR912, which was previously described in US-2007-0118929-A1 and published May 24, 2007, contains the hygromycin B phosphotransferase gene, flanked by the 35S promoter (Odell et al., *Nature* 313:810-812 (1985)) and NOS 3' transcription terminator (Depicker et al., *J. Mol. Appl. Genet.* 1:561-570 (1982)) (35S/hpt/NOS3' cassette) for selection in plants such as soybean. Vector pKR912 also contains EgD9e (SEQ ID NO:112), flanked by the promoter for the α' subunit of β-conglycinin (Beachy et al., *EMBO J.* 4:3047-3053 (1985)) and the 3' transcription termination region of the phaseolin gene (Doyle et al., *J. Biol. Chem.* 261:9228-9238 (1986)), thus allowing for strong tissue-specific expression of EgD9e in the seeds of soybean.

Plasmid pKR1007 (SEQ ID NO:473) was digested with PstI, and the fragment containing the *Tetruetreptia pomquetensis* delta-8 desaturase was cloned into the SbfI site of pKR912, to give pKR1014 (SEQ ID NO:474). In this way, the *Tetruetreptia pomquetensis* delta-8 desaturase is co-expressed with the *Euglena gracilis* delta-9 elongase behind strong, seed-specific promoters. A schematic depiction of pKR1014 is shown in FIG. 56. In FIG. 56, TpomD8 is called *Tetruetreptia pomquetensis* 1491 delta-8 Desaturase, and EgD9e is called eug el1.

Construction of pKR1151

In order to introduce NotI and NcoI restriction sites at the 5' end of the coding sequences and a NotI site at the 3' end of the coding sequences, EaD8 (SEQ ID NO:427) was amplified with oligonucleotide primers EaD8-5 (SEQ ID NO:475) and EaD8-3 (SEQ ID NO:476) using the Phusion™ High-Fidelity DNA Polymerase (Cat. No. F553S, Finnzymes Oy, Finland) following the manufacturer's protocol. The resulting DNA fragment was cloned into the pCR-Blunt® cloning vector using the Zero Blunt® PCR Cloning Kit (Invitrogen Corporation), following the manufacturer's protocol, to produce pLF120-3 (SEQ ID NO:477).

Vector pLF120-3 (SEQ ID NO:477), was digested with NotI, and the fragment containing EaD8 was cloned into the NotI site of pKR457 (SEQ ID NO:122; Example 16), to produce pKR1138 (SEQ ID NO:478).

Vector pKR1138 (SEQ ID NO:478) was digested with BsiWI, and the fragment containing EaD8 was cloned into the BsiWI site of pKR912 to give pKR1152 (SEQ ID NO:479). A schematic depiction of pKR1152 is shown in FIG. 57. In FIG. 57, EaD8 is called EaD8Des3, and EgD9e is called eug el1.

Construction of pKR1152

In order to introduce NotI and NcoI restriction sites at the 5' end of the coding sequences and a NotI site at the 3' end of the coding sequences, EaD9e was PCR amplified from pLF121-1 (SEQ ID NO:250; Example 36) with oligonucleotide primers oEAd9el1-1 (SEQ ID NO:298; Example 44) and oEAd9el1-2 (SEQ ID NO:480) using the Phusion™ High-Fidelity DNA Polymerase (Cat. No. F553S, Finnzymes Oy, Finland) following the manufacturer's protocol. The resulting DNA fragments were cloned into the pCR-Blunt□ cloning vector using the Zero Blunt□ PCR Cloning Kit (Invitrogen Corporation), following the manufacturer's protocol, to produce pKR1137 (SEQ ID NO:481).

EaD9e was released from pKR1137 (SEQ ID NO:481) by digestion with NotI and cloned into the NotI site of pKR72 (SEQ ID NO:105; Example 15) to produce pKR1140 (SEQ ID NO:482).

TpomD8 was released from pLF114-10 (SEQ ID NO:165; Example 21) by digestion with NotI and was cloned into the NotI site of plasmid pKR457 (SEQ ID NO:122; Example 16) to produce pKR1145 (SEQ ID NO:483).

Vector pKR1145 (SEQ ID NO:483) was digested with BsiWI and the fragment containing TpomD8 was cloned into the BsiWI site of pKR1140 (SEQ ID NO:482) to give pKR1151 (SEQ ID NO:484). A schematic depiction of pKR1151 is shown in FIG. 58. In FIG. 58, TpomD8 is called *Tetruetreptia pomquetensis* 1491 delta-8 Desaturase, and EaD9e is called EAd9elong.

Construction of pKR1150

Vector pKR1138 (SEQ ID NO:478) was digested with BsiWI, and the fragment containing EaD8 was cloned into the BsiWI site of pKR1140 (SEQ ID NO:482) to give pKR1150 (SEQ ID NO:485). A schematic depiction of pKR1150 is shown in FIG. 59. In FIG. 59, EaD8 is called EaD8Des3, and EaD9e is called EAd9elong.

Construction of pKR1199

The NcoI/NotI DNA fragment of KS373 (SEQ ID NO:179; Example 23), containing EgD9elo-EgDHAsyn1 Link, was cloned into the NcoI/NotI DNA fragment from pKR1177 (SEQ ID NO:264; Example 38), containing the promoter for the α' subunit of β-conglycinin, to produce pKR1190 (SEQ ID NO:486).

The NotI fragment from pLF114-10 (SEQ ID NO:165; Example 21), containing TpomD8, was cloned into the NotI fragment of pKR1190 (SEQ ID NO:486) to produce pKR1195 (SEQ ID NO:487).

The BamHI DNA fragment of pKR1195 (SEQ ID NO:487), containing the EgD9e/TpomD8 fusion gene, was cloned into the BamHI DNA fragment of pKR325, previously described in PCT Publication No. WO 2006/012325 to produce pKR1199 (SEQ ID NO:488). A schematic depiction of pKR1199 is shown in FIG. 60. In FIG. 60, EgD9e/TpomD8 is called EGd9elong-TPOMd8DS.

Construction of pKR1200

The NotI fragment from pLF120-3 (SEQ ID NO:477), containing EaD8 was cloned into the NotI fragment of pKR1190 (SEQ ID NO:486) to produce pKR1196 (SEQ ID NO:489).

The BamHI DNA fragment of pKR1196 (SEQ ID NO:489), containing the EgD9e/EaD8 fusion gene, was cloned into the BamHI DNA fragment of pKR325, previously described in PCT Publication No. WO 2006/012325 to produce pKR1200 (SEQ ID NO:490). A schematic depiction of pKR1200 is shown in FIG. 61. In FIG. 61, EgD9e/EaD8 is called EGd9ELONG-EaD8DS.

Construction of pKR1184

The NotI fragment from pLF120-3 (SEQ ID NO:477), containing EaD8, was cloned into the NotI fragment of pKR1179 (SEQ ID NO:265) to produce pKR1184 (SEQ ID NO:491). A schematic depiction of pKR1184 is shown in FIG. 62. In FIG. 62, EaD9e/EaD8 is called EAd9ELONG-EAd8DS.

Example 58

Construction of Soybean Expression Vector pKR1321 for Expression of a *Tetruetreptia pomquetensis* CCMP1491 Delta-8 Desaturase-*Euglena anabaena* delta-9 elongase Fusion Gene (TpomD8-EaD9Elo1 fusion)

The present example describes the construction of an in-frame fusion gene between the *Tetruetreptia pomquetensis* CCMP1491 delta-8 Desaturase (TpomD8; SEQ ID NO:162; Example 21) and the *Euglena anabaena* delta-9 elongase (EaD9e; SEQ ID NO:252, Example 36). Each domain is separated by the EgDHAsyn1 linker with an additional 4 amino acids included between the end of the EgDHAsyn1 proline-rich linker and the start of the EaD9e, as described in Example 57 (i.e. SEQ ID NO:472; PARPAGLPPATYYD-SLAVSGRT).

Plasmid pKR1301 (SEQ ID NO:307; Example 44) was digested with EcoRI, and the DNA fragment containing the 3' end of TpomD8-EgDHAsyn1 Link (called TpomD8+L1 TR1) was re-ligated to form pKR1303 (SEQ ID NO:497).

The NotI fragment of pKR1137 (SEQ ID NO:481; Example 57), containing the EaD9e, was cloned into the EagI site of pKR1303 (SEQ ID NO:497) to produce pKR1308 (SEQ ID NO:498). In this way, EaD9e was fused to the 3' end of TpomD8.

The Gy1/Pavelo/legA2 cassette was released from plasmid pKR336 (described in PCT Publication Nos. WO 04/071467; the contents of which are hereby incorporated by reference) by digestion with PstI/BamHI and cloned into the PstI/BamHi site of pKR268 (described in PCT Publication Nos. WO 04/071467) to produce pKR393 (SEQ ID NO:499). The Pavelo gene was released from pKR393 (SEQ ID NO:499) by digestion with NotI, and the vector was re-ligated to form pKR407 (SEQ ID NO:500).

TpomD8 was released from pLF114-10 (SEQ ID NO:165; Example 21) by digestion with NotI and was cloned into the NotI site of plasmid pKR407 (SEQ ID NO:500) to produce pKR1018 (SEQ ID NO:501).

Plasmid pKR1018 (SEQ ID NO:501) was digested with HindIII/EcoRI, and the fragment containing the 5' end of the Tpomd8 was cloned into the HindIII/EcoRI site of pKR1308 (SEQ ID NO:498) to produce pKR1312 (SEQ ID NO:502). In this way, the TpomD8 sequence was restored, and the TpomD8/EaD9e fusion was formed.

The NotI fragment of pKR1312 (SEQ ID NO:502), containing the TpomD8/EaD9e fusion, was cloned into the NotI site of pKR72 (SEQ ID NO:105; Example 23) to produce pKR1321 (SEQ ID NO:503). A schematic depiction of pKR1321 is shown in FIG. 63. In FIG. 63, TpomD8/EaD9e is called TPd8ds-EAd9el fusion.

Example 59

Construction of Soybean Expression Vector pKR1326 for Expression of a *Euglena anabaena* delta-9 elongase-*Tetruetreptia pomquetensis* CCMP1491 Delta-8 Desaturase Fusion Gene Using the *Euglena anabaena* DHAsyn1 Proline-Rich Linker The present example describes the construction of an in-frame fusion gene between the *Euglena anabaena* delta-9 elongase (EaD9e; SEQ ID NO:252, Example 36) and the *Tetruetreptia pomquetensis* CCMP1491 delta-8 Desaturase (TpomD8; SEQ ID NO:162; Example 21). Each domain is separated by the EaDHAsyn1 proline-rich linker (SEQ ID NO:235), but with an additional 3 amino acids included between the end of the EaDHAsyn1 proline-rich linker (EaDHAsyn1 Link) and the start of the EaD9e (i.e. SEQ ID NO:504; PGGPGKPSEIASLPPPIRPVGNPPAAYY-DALATGRT). Cloning was performed as similarly described in Example 57.

An initial in-frame fusion between the EaD9e and the EaDHAsyn1 Link (EaD9elo-EgDHAsyn1 Link) was made by PCR amplification and was flanked by a NotI and NcoI site at the 5' end and a NotI site at the 3' end. EaD9e (SEQ ID NO:252) was amplified from pLF121-1 (SEQ ID NO:250) with oligonucleotides oEAd9el1-1 (SEQ ID NO:298) and EaLink1 (SEQ ID NO:505), using the Phusion™ High-Fidelity DNA Polymerase (Cat. No. F553S, Finnzymes Oy, Finland) following the manufacturer's protocol. EaDHAsyn1 Link (SEQ ID NO:234) was amplified in a similar way from pLF117-1 (SEQ ID NO:87; Example 13) with oligonucleotides EaLink2 (SEQ ID NO:506) and EaLink3 (SEQ ID NO:507). The two resulting PCR products were combined and re-amplified using oEAd9el1-1 (SEQ ID NO:298) and EaLink3 (SEQ ID NO:507) to form EaD9e-EaDHAsyn1 Link. The sequence of the EaD9e-EaDHAsyn1 Link is shown in SEQ ID NO:508. EaD9e-EaDHAsyn1 Link was cloned into the pCR-Blunt® cloning vector using the Zero Blunt® PCR Cloning Kit (Invitrogen Corporation), following the manufacturer's protocol, to produce pKR1305 (SEQ ID NO:509).

The EagI DNA fragment of pKR1305 (SEQ ID NO:509), containing EaD9e-EaDHAsyn1Link, was cloned into the NotI site pKR1304 (SEQ ID NO:310; Example 44) to produce pKR1317 (SEQ ID NO:510). In this way, the 5' end of the TpomD8 was fused to EaD9e-EaDHAsyn1Link.

The EcoRI/Asp718 fragment of pKR1127 (SEQ ID NO:168; Example 22), containing the 3' end of the TpomD8 was cloned into the EcoRI/Asp718 fragment of pKR1317 (SEQ ID NO:510), containing EaD9e-EaDHAsyn1 Link to produce pKR1320 (SEQ ID NO:511).

The NotI fragment from pKR1320 (SEQ ID NO:511), containing the fusion, was cloned into the NotI fragment of pKR72 (SEQ ID NO:105; Example 15) to produce pKR1326 (SEQ ID NO:512). A schematic depiction of pKR1326 is shown in FIG. 64. In FIG. 64, EaD9e/TpomD8 with the EaDHAsyn1 proline-rich linker is called EAd9el-TPOMd8ds L2fusion.

Example 60

Functional Analyses of Delta-9 Elongase/Delta-8 Desaturase Gene Fusions in Soy

The present example describes the transformation and expression in soybean somatic embryos of pKR1014 (SEQ ID NO:474), pKR1152 (SEQ ID NO:479), pKR1151 (SEQ ID NO:484), pKR1150 (SEQ ID NO:485), pKR1199 (SEQ ID NO:488), pKR1200 (SEQ ID NO:490), and pKR1184 (SEQ ID NO:491), the syntheses of which were previously described in Example 57. Functional analyses of pKR1183 (SEQ ID NO:266) and KS373 (SEQ ID NO:179) were previously described in Examples 46 and 31, respectively.

Soybean embryogenic suspension culture (cv. Jack) was transformed with each of the vectors above, and embryos were matured in soybean histodifferentiation and maturation liquid medium (SHaM liquid media; Schmidt et al., *Cell Biology and Morphogenesis*, 24:393 (2005)), as described in Example 25 and previously described in PCT Publication No. WO 2007/136877, published Nov. 29, 2007 (the contents of which are hereby incorporated by reference).

After maturation in SHaM liquid media, a subset of transformed soybean embryos (i.e., 5-6 embryos per event) were harvested and analyzed as described herein.

In this way, approximately 30 events transformed with pKR1014 (SEQ ID NO:474), pKR1152 (SEQ ID NO:479), pKR1151 (SEQ ID NO:484), pKR1150 (SEQ ID NO:485), pKR1199 (SEQ ID NO:488), pKR1200 (SEQ ID NO:490), or pKR1184 (SEQ ID NO:491) were analyzed. The five events having the highest average DGLA content (average of the 5 embryos analyzed) are shown in FIG. 65, 66, 67, 68, 69, 70, or 71, respectively. In FIGS. 65-71, fatty acids are identified as 16:0 (palmitate), 18:0 (stearic acid), 18:1 (oleic acid), LA, ALA, EDA, ERA, DGLA, and ETA. Fatty acid compositions are expressed as a weight percent (wt. %) of total fatty acids. Table 36 summarizes the vector, genes used, experiment number (MSE#), and corresponding FIG.

In FIGS. 65-71, elongation activity is expressed as % delta-9 elongation of C18 fatty acids (C18% delta-9 elong), calculated according to the following formula: ([product]/[substrate+product])*100. More specifically, the combined percent elongation for LA and ALA is determined as: ([DGLA+ETA+EDA+ERA]/[LA+ALA+DGLA+ETA+EDA+ERA])*100.

In FIGS. 65-71, the combined percent desaturation for EDA and ERA is shown as "C20% delta-8 desat", determined as: ([DGLA+ETA]/[DGLA+ETA+EDA+ERA])*100. This is also referred to as the overall % desaturation.

TABLE 36

Functional analysis of Delta-9/Delta-8 Gene Fusions In Soy

| Vector | Gene(s) Expressed | MSE Experiment | FIG. # Containing Functional Analysis |
| --- | --- | --- | --- |
| pKR1014 | EgD9e TpomD8 | MSE2024 | FIG. 65 |
| pKR1152 | EgD9e EaD8 | MSE2136 | FIG. 66 |
| pKR1151 | EaD9e TpomD8 | MSE2131 | FIG. 67 |
| pKR1150 | EaD9e EaD8 | MSE2130 | FIG. 68 |
| pKR1199 | EgD9e/TpomD8 fusion | MSE2153 | FIG. 69 |
| pKR1200 | EgD9e/EaD8 fusion | MSE2154 | FIG. 70 |
| pKR1183 | EaD9e/TpomD8 fusion | MSE2145 (Example 46)* | FIG. 37 |
| pKR1184 | EaD9e/EaD8 fusion | MSE2146 | FIG. 71 |
| KS373 | EgD9e/PavD8 fusion | MSE2071 (Example 31) | FIG. 24 |

*In FIG. 37, MSE2145 is listed as MSE2144

A comparison of individually expressed delta-9 elongases with delta-8 desaturases versus the equivalent delta-9 elongase-delta-8 desaturase fusion is shown in FIG. 72. In FIG. 72, each data point represents the average % DGLA or % EDA for 5-6 embryos (as a % of total fatty acids) for all events analyzed, and avg. % DGLA is plotted vs. avg. % EDA. In FIG. 72A, EgTpom represents EgD9e co-expressed with TpomD8 (pKR1014), and EgTpomfus represents the EgD9e/TpomD8 fusion (pKR1199). In FIG. 72B, EgEa represents EgD9e co-expressed with EaD8 (pKR1152), and EgEafus represents the EgD9e/EaD8 fusion (pKR1200). In FIG. 72C, EaTpom represents EaD9e co-expressed with TpomD8 (pKR1151), and EaTpomfus represents the EaD9e/TpomD8 fusion (pKR1183). In FIG. 72D, EaEa represents EaD9e co-expressed with EaD8 (pKR1150), and EaEafus represents the EaD9e/EaD8 fusion (pKR1200).

Example 61

Functional Analyses of Delta-9 Elongase/Delta-8 Desaturase/Delta-5 Desaturase Gene Fusion The present example describes the transformation and expression in soybean somatic embryos of pKR1322 (SEQ ID NO:314; Example 50) comprising a EaD9Elo1-TpomD8-EaD5Des1 triple fusion (also called EaD9e/TpomD8/EaD5). Each domain is separated by the EgDHAsyn1 linker with an additional 4 amino acids (i.e. SEQ ID NO:472; PARPAGLP-PATYYDSLAVSGRT).

Soybean embryogenic suspension culture (cv. Jack) was transformed with pKR1322, and embryos were matured in soybean histodifferentiation and maturation liquid medium (SHaM liquid media; Schmidt et al., *Cell Biology and Mor-*

*phogenesis*, 24:393 (2005)) as described in Example 25 and previously described in PCT Publication No. WO 2007/136877, published Nov. 29, 2007 (the contents of which are hereby incorporated by reference).

After maturation in SHaM liquid media, a subset of transformed soybean embryos (i.e., 5embryos per event) were harvested and analyzed as described herein.

In this way, approximately 30 events transformed with pKR1322 (Experiment MSE2274) were analyzed, and the five events having the highest average ARA and EPA content (average of the 5 embryos analyzed) are shown in FIG. 73. In FIG. 73, fatty acids are identified as 16:0 (palmitate), 18:0 (stearic acid), 18:1 (oleic acid), 18:2 (5,9), LA, ALA, EDA, ERA, SCI, DGLA, JUN (also called JUP), ETA, ARA, and EPA. Fatty acid compositions are expressed as a weight percent (wt. %) of total fatty acids.

In FIG. 73, elongation activity is expressed as % delta-9 elongation of C18 fatty acids (% Elo), calculated according to the following formula: ([product]/[substrate+product])*100. More specifically, the combined percent elongation for LA and ALA is determined as: ([DGLA+ETA+EDA+ERA+EPA+ARA]/[LA+ALA+DGLA+ETA+EDA+ERA+EPA+ARA])*100.

In FIG. 73, the combined percent delta-8 desaturation for EDA and ERA is shown as "% D8", determined as: ([DGLA+ETA+EPA+ARA]/[DGLA+ETA+EDA+ERA+EPA+ARA])*100. This is also referred to as the overall % delta-8 desaturation.

In FIG. 73, the combined percent delta-5 desaturation for DGLA and ETA is shown as "% D5", determined as: ([EPA+ARA]/[DGLA+ETA+EPA+ARA])*100. This is also referred to as the overall % delta-5 desaturation.

In summary of FIG. 73, all three domains are functional. This fusion could be referred to as either EPA synthase or ARA synthase.

Example 62

Functional Analyses of Delta-9 Elongase/Delta-8 Desaturase and Delta-8 Desaturase/Delta-9 Elongase Gene Fusions The present example describes the transformation and expression in soybean somatic embryos of either pKR1326 (SEQ ID NO:512), comprising an EaD9Elo1-TpomD8 fusion (also called EaD9e/TpomD8) separated by the EaDHAsyn1 linker with an additional 3 amino acids (i.e. SEQ ID NO:504; PGGPGKPSEIASLPPPIRPVGNPPAAYY-DALATGRT), or pKR1321 (SEQ ID NO:503; Example 58), comprising TpomD8/EaD9e fusion separated by the EgDHAsyn1 linker.

Soybean embryogenic suspension culture (cv. Jack) was transformed with pKR1326 or pKR1321, and embryos were matured in soybean histodifferentiation and maturation liquid medium (SHaM liquid media; Schmidt et al., *Cell Biology and Morphogenesis*, 24:393 (2005)), as described in Example 25 and previously described in PCT Publication No. WO 2007/136877, published Nov. 29, 2007 (the contents of which are hereby incorporated by reference).

After maturation in SHaM liquid media, a subset of transformed soybean embryos (i.e., 5embryos per event) were harvested and analyzed as described herein.

In this way, approximately 30 events transformed with pKR1326 (Experiment MSE2275) were analyzed, and the five events having the highest average DGLA and ETA content (average of the 5 embryos analyzed) are shown in FIG. 74. In FIG. 74, fatty acids are identified as 16:0 (palmitate), 18:0 (stearic acid), 18:1 (oleic acid), LA, ALA, EDA, ERA, DGLA and DGLA, and ETA. Fatty acid compositions are expressed as a weight percent (wt. %) of total fatty acids.

In FIG. 74, elongation activity is expressed as % delta-9 elongation of C18 fatty acids (C18% delta-9 elong), calculated according to the following formula: ([product]/[substrate+product])*100. More specifically, the combined percent elongation for LA and ALA is determined as: ([DGLA+ETA+EDA+ERA]/[LA+ALA+DGLA+ETA+EDA+ERA])*100.

In FIG. 74, the combined percent desaturation for EDA and ERA is shown as "C20% delta-8 desat", determined as: ([DGLA+ETA]/[DGLA+ETA+EDA+ERA])*100. This is also referred to as the overall % desaturation.

In summary of FIG. 74, the EaDHAsyn1 linker functions similarly to the EgDHAsyn1 linker. No activity was detected for any of the events transformed with pKR1321 where TpomD8 was fused to EaD9e with the EgDHAsyn1 linker.

---

SEQUENCE LISTING (519 sequences)

SEQ ID NO: 1 - DNA, 18 bp, Artificial Sequence
  M13F universal primer
tgtaaaacgacggccagt

SEQ ID NO: 2 - protein, 277 aa, Pavlova sp. CCMP459
MMLAAGYLLVLSAARQSFQQDIDNPNGAYSTSWTGLPIVMSVVYLSGVFGLTKYFENRKPMTGLKDYMFTYNLYQVIINVWCVVAFLLEVRRAGMSLIGNKVDLGPNSFRLGFVTWVHYNNKYVELLDTLWMVLRKKTQQVSFLHVYHHVLLMWAWFVVVKLGNGGDAYFGGLMNSIIHVMMYSYYTMALLGWSCPWKRYLTQAQLVQFCICLAHSTWAAVTGAYPWRICLVEVWVMVSMLVLFTRFYRQAYAKEAKAKEAKKLAQEASQAKAVKAE

SEQ ID NO: 3 - DNA, 608 bp, Euglena gracilis
attgtattgcctgcacaatggcggatagcccagtcatcaacctcagcaccatgtggaaacccctttcactgatgggacatgtctggaagcaggcacaacaggagggcagcatttcggcctatgctgattctgttcggattcctctcattatgtccgttttatacttatcaatgatcttcgtggggtgccgctggatgaagaaccgtgagccctttgagatcaaaacatacatgtttgcgtataacctgtatcagaccttgatgaacctttgcatcgtgttgggattcttgtaccaggtgcatgccactgggatgcgcttttggggaagtggtgtcgaccgaagcccgaaaggtttgggcattggcttcttcatttatgcccactaccacaacaagtatgtggaatattttgatacactttttatggtgctgcgaaagaagaacaaccagatttctttccttcacgtgtatcatcatgccctgttgacatgggcttggtttgctgttgtgtatttcgcacctggaggtgatggctggtttggagcttgctacaattcttccatccatgtcctgatgtactcttactacttgcttgcaacttttggcatc

SEQ ID NO: 4 - DNA, 1327 bp, Euglena gracilis
gcattgtattgcctgcacaatggcggatagcccagtcatcaacctcagcaccatgtggaaacccctttcactgatgggacatgtctggaagcaggcacaacaggagggcagcatttcggcctatgctgattctgttcggattcctctcattatgtccgttttatacttatcaatgatcttcgtggggtgccgctggatgaagaaccgtgagccctttgagatcaaaacatacatgtttgcgtataacctgtatcagaccttgatgaacctttgcatcgtgttgggattcttgtaccaggtgcatgccactgggatgcgcttttggggaagtggtgtcgaccgaagcccgaaaggtttgggcattggcttcttcatttatgcccactaccacaacaagtatgtggaatattttgatacactttttatggtgctgcgaaagaagaacaaccagatttctttccttcacgtgtatcatcatgccctgttgacatgggcttggtttgctgttgtgtatttcgcacctggaggtgatggctggtttggagcttgctacaattcttccatccatgtcctgatgtactcttactacttgcttgcaacttttggcatcagttgcccatggaagaagatcttgacacagctccagatggttcagttctgtttctgttttacacattccatttatgtgtggatttgcgggtcagagatctacccacggcctctgactgctttgcagtcgttcgtgatggtcaatatgttggtgctgtttggcaatttctatgtcaagcaatactcccaaaagaacggcaagccggagaacggagccacccctgagaacggagcgaagccgcaaccttgcgagaacggcacggtggaaaagcgagaggcgccccgatctgtcggcatgggacgctgaggagtccaaatgcacggaaaggagctagcgatgcctcacgagctaatctgcctcggagtagactcccacatttctcctgctctgtgttttgctctcctcagtccccattggctctccagtgaccgcgctttcccctcttctgtcaagccaccctcctgcatgggttccagcggagcttctgaccgcttcgacattttccttgcgcagccctgcctcacgcagcggacatttttgggcactgcggtgcagtgtttatgtgtcctcccaccccgtcttaccctccccctggcttgctcggaccatccagctcgtttatcctctcctctcctgtggcagcgttgcctcggagtggaaagcttcagataagcatctttcctcctttgcattcaatgctccacaagaaactctcaa

SEQ ID NO: 5 - DNA, 897 bp, Euglena gracilis
atggcggatagcccagtcatcaacctcagcaccatgtggaaacccctttcactgatgggacatgtctggaagcaggcacaacaggagggcagcatttcggcctatgctgattctgttcggattcctctcattatgtccgttttatacttatcaatgatcttcgtggggtgccgctggatgaagaaccgtgagccctttgagatcaaaacatacatgtttgcgtataacctgtatcagaccttgatgaacctttgcatcgtgttgggattcttgtaccaggtgcatgccactgggatgcgcttttggggaagtggtgtcgaccgaagcccgaaaggtttgggcattggcttcttcatttatgcccactaccacaacaagtatgtggaatattttgatacactttttatggtgctgcgaaagaagaacaaccagatttctttccttcacgtgtatcatcatgccctgttgacatgggcttggtttgctgttgtgtatttcgcacctggaggtgatggctggtttggagcttgctacaattcttccatccatgtcctgatgtactcttactacttgcttgcaacttttggcatcagttgcccatggaagaagatcttgacacagctccagatggttcagttctgtttctgttttacacattccatttatgtgtggatttgcgggtcagagatctacccacggcctctgactgctttgcagtcgttcgtgatggtcaatatgttggtgctgtttggcaatttctatgtcaagcaatactcccaaaagaacggcaagccggagaacggagccacccctgagaacggagcgaagccgcaaccttgcgagaacggcacggtggaaaagcgagaggcgccccgatctgtcggcatgggacgctga

SEQ ID NO: 6 - protein, 298 aa, Euglena gracilis
MADSPVINLSTMWKPLSLMGHVWKQAQQEGSISAYADSVRIPLIMSVLYLSMIFVGCRWMKNREPFEIKTYMFAYNLYQTLMNLCIVLGFLYQVHATGMRFWGSGVDRSPKGLGIGFFIYAHYHNKYVEYFDTLFMVLRKKNNQISFLHVYHHALLTWAWFAVVYFAPGGDGWFGACYNSSIHVLMYSYYLLATFGISCPWKKILTQLQMVQFCFCFTHSIYVWICGSEIYPRPLTALQSFVMVNMLVLFGNFYVKQYSQKNGKPENGATPENGAKPQPCENGTVEKREAPRSVGMGR

SEQ ID NO: 7 - DNA, 20 bp, Artificial Sequence
  sequencing primer SeqE
cgacacactccaatctttcc

SEQ ID NO: 8 - DNA, 20 bp, Artificial Sequence
  sequencing primer SeqW
ggtggctggagttagacatc

SEQ ID NO: 9 - DNA, 742 bp, Euglena gracilis
attttttttcggtgcggcgcattgtattgcctgcacaatggcggatagcccagtcatcaacctcagcaccatgtggaaacccctttcactgatggctttggaccttgccgttttgggacatgtctggaagcaggcacaacaggagggcagcatttcggcctatgctgattctgtttggactcctctcattatgtccggtttatacttatcaatgatcttcgtggggtgccgctggatgaagaaccgtgaaccctttgagatcaaaacatacatgtttgcgtataacctgtatcagaccttgatgaacctttgcatcgtgttgggattcttgtaccaggtgcatgccactgggatgcgcttttggggaagtggtgtcgaccgaagcccaaaaggtttgggcattggcttcttcatttatgcccactaccacaacaagtatgtggaatattttgatacactttttatggtgctgcgaaagaagaacaaccagatttctttccttcacgtgtatcatcatgccctgttgacatgggcttggtttgctgttgtgtatttcgcacctggaggtgatggctggtttggagcttgctacaattcttccatccatgtcctgatgtactcttactacttgcttgcaacttttggcatcagttgcccatggaagaagatcttgacacagctccagatggttcaattctgtttctgttttacacattccatttatgtgtggatttgcgggtca

SEQ ID NO: 10 - DNA, 2630 bp, Euglena gracilis
attttttttcggtgcggcgcattgtattgcctgcacaatggcggatagcccagtcatcaacctcagcaccatgtggaaacccctttcactgatggctttggaccttgccgttttgggacatgtctggaagcaggcacaacaggagggcagcatttcggcctatgctgattctgtttggactcctctcattatgtccggtttatacttatcaatgatcttcgtggggtgccgctggatgaagaaccgtgaaccctttgagatcaaaacatacatgtttgcgtataacctgtatcagaccttgatgaacctttgcatcgtgttgggattcttgtaccaggtgcatgccactgggatgcgcttttggggaagtggtgtcgaccgaagcccaaaaggtttgggcattggcttcttcatttatgcccactaccacaacaagtatgtggaatattttgatacactttttatggtgctgcgaaagaagaacaaccagatttctttccttcacgtgtatcatcatgccctgttgacatgggcttggtttgctgttgtgtatttcgcacctggaggtgatggctggtttggagcttgctacaattcttccatccatgtcctgatgtactcttactacttgcttgcaacttttggcatcagttgcccatggaagaagatcttgacacagctccagatggttcaattctgtttctgttttacacattccatttatgtgtggatttgcgggtcagagatctacccacggcctctgactgctttgcagtcgttcgtgatggtcaatatgttggtgctgtttggcaatttctatgtcaagcaatactcccaaaagaacggcaagccggagaacggagccacccctgagaacggagcgaagccgcaaccttgcgagaacggcacggtggaaaagcgagagaatgacaccgccaacgttcggcccgcccgtccagctggactcccgccggccacgtactacgactccctggcagtgtcggggcagggcaaggagcggctgttcaccaccgatgaggtgaggcggcacatcctccccaccgatggctggctgacgtgccacgaaggagtctacgatgtcactgatttccttgccaagcaccctggtggcggtgtcatcacgctgggccttggaagggactgcacaatcctcgtcgagtcataccaccctgctgggcgcccggacaaggtgatggagaagtaccgcattggtacgctgcaggaccccaagacgttctatgcttggggagagtccgatttctaccctgagttgaagcgccgggcccttgcaaggctgaaggaggctggtcaggcgcggcgcggcggccttggggtgaaggccctcctggtgctcaccctcttcttcgtgtcgtggtacatgtgggtggcccacaagtccttcctctgggccgccgtctggggcttcgccggctcccacgtcgggctgagcatccagcacgacggcaaccacggcgcgttcagccgcagcacactggtgaaccgcctggcggggtggggcatggacttgatcggcgcgtcgtcaacggtgtgggagtaccagcacgtcatcggccaccaccagtacaccaacctcgtgtcggacacgctattcagtctgcctgagaacgatccggacgtcttctccagctacccgctgatgcgcatgcacccggatacggcgtggcagccgcaccaccgcttccagcacctgttcgcgttcccactgttcgccctgatgacaatcagcaaggtgctgaccagcgatttcgctgtctgcctcagcatgaagaaggggtccatcgactgctcctccaggctcgtcccactggaggggcagctgctgttctggggggccaagctggcgaacttcctgttgcagattgtgttgccatgctacctccacgggacagctatgggcctggccctcttctctgttgcccaccttgtgtcgggggagtacctcgcgatctgcttcatcatcaaccacatcagcgagtcttgtgagtttatgaatacaagctttcaaaccgccgcccggaggacagagatgcttcaggcagcccatcaggcagcggaggccaagaaggtgaagcccacccctccaccgaacgattgggctgtgacacaggtccaatgctgcgtgaattggagatcaggtggcgtgttggccaatcacctctctggaggcttgaaccaccagatcgagcatcatctgttccccagcatctcgcatgccaactaccccatcatcgcccgtgttgtgaaggaggtgtgcgaggagtatgggttgccgtacaagaactacgtcacgttctgggatgcagtctgtggcatggttcagcacctccggttgatgggtgctccaccggtgccaacgaacggggacaaaaagtcataagccacgacatcatttggggctcactccgtgcagccttttcttgggctgcccacgaagatgcgcgatgaggcacctggtggttgccctccgccggcctcggaaaacggttcgacgcctgctccttcagcccagagcactccggcgaagagtgaaagagcactgacctgaattttatgatgacccatttttttaaaaaaaaaaaaaaaaaaaa

SEQ ID NO: 11 - DNA, 2382 bp, Euglena gracilis
atggcggatagcccagtcatcaacctcagcaccatgtggaaacccctttcactgatggctttggaccttgccgttttgggacatgtctggaagcaggcacaacaggagggcagcatttcggcctatgctgattctgtttggactcctctcattatgtccggtttatacttatcaatgatcttcgtggggtgccgctggatgaagaaccgtgaaccctttgagatcaaaacatacatgtttgcgtataacctgtatcagaccttgatgaacctttgcatcgtgttgggattcttgtaccaggtgcatgccactgggatgcgcttttggggaagtggtgtcgaccgaagcccaaaaggtttgggcattggcttcttcatttatgcccactaccacaacaagtatgtggaatattttgatacactttttatggtgctgcgaaagaagaacaaccagatttctttccttcacgtgtatcatcatgccctgttgacatgggcttggtttgctgttgtgtatttcgcacctggaggtgatggctggtttggagcttgctacaattcttccatccatgtcctgatgtactcttactacttgcttgcaacttttggcatcagttgcccatggaagaagatcttgacacagctccagatggttcaattctgtttctgttttacacattccatttatgtgtggatttgcgggtcagagatctacccacggcctctgactgctttgcagtcgttcgtgatggtcaatatgttggtgctgtttggcaatttctatgtcaagcaatactcccaaaagaacggcaagccggagaacggagccacccctgagaacggagcgaagccgcaaccttgcgagaacggcacggtggaaaagcgagagaatgacaccgccaacgttcggcccgcccgtccagctggactcccgccggccacgtactacgactccctggcagtgtcggggcagggcaaggagcggctgttcaccaccgatgaggtgaggcggcacatcctccccaccgatggctggctgacgtgccacgaaggagtctacgatgtcactgatttccttgccaagcaccctggtggcggtgtcatcacgctgggccttggaagggactgcacaatcctcgtcgagtcataccaccctgctgggcgcccggacaaggtgatggagaagtaccgcattggtacgctgcaggaccccaagacgttctatgcttggggagagtccgatttctaccctgagttgaagcgccgggcccttgcaaggctgaaggaggctggtcaggcgcggcgcggcggccttggggtgaaggccctcctggtgctcaccctcttcttcgtgtcgtggtacatgtgggtggcccacaagtccttcctctgggccgccgtctggggcttcgccggctcccacgtcgggctgagcatccagcacgacggcaaccacggcgcgttcagccgcagcacactggtgaaccgcctggcggggtggggcatggacttgatcggcgcgtcgtcaacggtgtgggagtaccagcacgtcatcggccaccaccagtacaccaacctcgtgtcggacacgctattcagtctgcctgagaacgatccggacgtcttctccagctacccgctgatgcgcatgcacccggatacggcgtggcagccgcaccaccgcttccagcacctgttcgcgttcccactgttcgccctgatgacaatcagcaaggtgctgaccagcgatttcgctgtctgcctcagcatgaagaaggggtccatcgactgctcctccaggctcgtcccactggaggggcagctgctgttctggggggccaagctggcgaacttcctgttgcagattgtgttgccatgctacctccacgggacagctatgggcctggccctcttctctgttgcccaccttgtgtcgggggagtacctcgcgatctgcttcatcatcaaccacatcagcgagtcttgtgagtttatgaatacaagctttcaaaccgccgcccggaggacagagatgcttcaggcagcccatcaggcagcggaggccaagaaggtgaagcccacccctccaccgaacgattgggctgtgacacaggtccaatgctgcgtgaattggagatcaggtggcgtgttggccaatcacctctctggaggcttgaaccaccagatcgagcatcatctgttccccagcatctcgcatgccaactaccccatcatcgcccgtgttgtgaaggaggtgtgcgaggagtatgggttgccgtacaagaactacgtcacgttctgggatgcagtctgtggcatggttcagcacctccggttgatgggtgctccaccggtgccaacgaacggggacaaaaagtcataa

SEQ ID NO: 12 - protein, 793 aa, Euglena gracilis
MADSPVINLSTMWKPLSLMALDLAVLGHVWKQAQQEGSISAYADSVWTPLIMSGLYLSMIFVGCRWMKNREPFEIKTYMFAYNLYQTLMNLCIVLGFLYQVHATGMRFWGSGVDRSPKGLGIGFFIYAHYHNKYVEYFDTLFMVLRKKNNQISFLHVYHHALLTWAWFAVVYFAPGGDGWFGACYNSSIHVLMYSYYLLATFGISCPWKKILTQLQMVQFCFCFTHSIYVWICGSEIYPRPLTALQSFVMVNMLVLFGNFYVKQYSQKNGKPENGATPENGAKPQPCENGTVEKRENDTANVRPARPAGLPPATYYDSLAVSGQGKERLFTTDEVRRHILPTDGWLTCHEGVYDVTDFLAKHPGGGVITLGLGRDCTILVESYHPAGRPDKVMEKYRIGTLQDPKTFYAWGESDFYPELKRRALARLKEAGQARRGGLGVKALLVLTLFFVSWYMWVAHKSFLWAAVWGFAGSHVGLSIQHDGNHGAFSRSTLVNRLAGWGMDLIGASSTVWEYQHVIGHHQYTNLVSDTLFSLPENDPDVFSSYPLMRMHPDTAWQPHHRFQHLFAFPLFALMTISKVLTSDFAVCLSMKKGSIDCSSRLVPLEGQLLFWGAKLANFLLQIVLPCYLHGTAMGLALFSVAHLVSGEYLAICFIINHISESCEFMNTSFQTAARRTEMLQAAHQAAEAKKVKPTPPPNDWAVTQVQCCVNWRSGGVLANHLSGGLNHQIEHHLFPSISHANYPIIARVVKEVCEEYGLPYKNYVTFWDAVCGMVQHLRLMGAPPVPTNGDKKS

SEQ ID NO: 13 - protein, 541 aa, Euglena gracilis
  MISC_FEATURE (1)..(541): NCBI Accession No. AAQ19605 (GI 33466346), locus AAQ19605, CDS AY278558
MLVLFGNFYVKQYSQKNGKPENGATPENGAKPQPCENGTVEKRENDTANVRPTRPAGPPPATYYDSLAVSGQGKERLFTTDEVRRHILPTDGWLTCHEGVYDVTDFLAKHPGGGVITLGLGRDCTILIESYHPAGRPDKVMEKYRIGTLQDPKTFYAWGESDFYPELKRRALARLKEAGQARRGGLGVKALLVLTLFFVSWYMWVAHKSFLWAAVWGFAGSHVGLSIQHDGNHGAFSRNTLVNRLAGWGMDLIGASSTVWEYQHVIGHHQYTNLVSDTLFSLPENDPDVFSSYPLMRMHPDTAWQPHHRFQHLFAFPLFALMTISKVLTSDFAVCLSMKKGSIDCSSRLVPLEGQLLFWGAKLANFLLQIVLPCYLHGTAMGLALFSVAHLVSGEYLAICFIINHISESCEFMNTSFQTAARRTEMLQAAHQAAEAKKVKPTPPPNDWAVTQVQCCVNWRSGGVLANHLSGGLNHQIEHHLFPSISHANYPTIAPVVKEVCEEYGLPYKNYVTFWDAVCGMVQHLRLMGAPPVPTNGDKKS

SEQ ID NO: 14 - DNA, 22 bp, Artificial Sequence
  primer M13-28Rev
gtaatacgactcactatagggc

SEQ ID NO: 15 - DNA, 17 bp, Artificial Sequence
  oligonucleotide oEUGel4-1
ggaagtggtgtcgaccg

SEQ ID NO: 16 - DNA, 45 bp, Artificial Sequence
  oligonucleotide EgEloD4Mut-5
caacttttggcatcagttgcccttggaagaagatcttgacacagc

SEQ ID NO: 17 - DNA, 20 bp, Artificial Sequence
  oligonucleotide oEUGel4-2
cacctgatctccaattcacg

SEQ ID NO: 18 - DNA, 18 bp, Artificial Sequence
  oligonucleotide oEgDHAsyn5'
ctgagaacggagcgaagc

SEQ ID NO: 19 - DNA, 19 bp, Artificial Sequence
  oligonucleotide EgDHAsyn3'
gtagctggagaagacgtcc

SEQ ID NO: 20 - DNA, 2630 bp, Euglena gracilis
tttttttttttttttttttttaaaaaaatgggtcatcataaaattcaggtcagtgctctttcactcttcgccggagtgctctgggctgaaggagcaggcgtcgaaccgttttccgaggccggcggagggcaaccaccaggtgcctcatcgcgcatcttcgtgggcagcccaagaaaaggctgcacggagtgagccccaaatgatgtcgtggcttatgactttttgtccccgttcgttggcaccggtggagcacccatcaaccggaggtgctgaaccatgccacagactgcatcccagaacgtgacgtagttcttgtacggcaacccatactcctcgcacacctccttcacaacacgggcgatgatggggtagttggcatgcgagatgctggggaacagatgatgctcgatctggtggttcaagcctccagagaggtgattggccaacacgccacctgatctccaattcacgcagcattggacctgtgtcacagcccaatcgttcggtggaggggtgggcttcaccttcttggcctccgctgcctgatgggctgcctgaagcatctctgtcctccgggcggcggtttgaaagcttgtattcataaactcacaagactcgctgatgtggttgatgatgaagcagatcgcgaggtactcccccgacacaaggtgggcaacagagaagagggccaggcccatagctgtcccgtggaggtagcatggcaacacaatctgcaacaggaagttcgccagcttggccccccagaacagcagctgcccctccagtgggacgagcctggaggagcagtcgatggaccccttcttcatgctgaggcagacagcgaaatcgctggtcagcaccttgctgattgtcatcagggcgaacagtgggaacgcgaacaggtgctggaagcggtggtgcggctgccacgccgtatccgggtgcatgcgcatcagcgggtagctggagaagacgtccggatcgttctcaggcagactgaatagcgtgtccgacacgaggttggtgtactggtggtggccgatgacgtgctggtactcccacaccgttgacgacgcgccgatcaagtccatgccccaccccgccaggcggttcaccagtgtgctgcggctgaacgcgccgtggttgccgtcgtgctggatgctcagcccgacgtgggagccggcgaagccccagacggcggcccagaggaaggacttgtgggccacccacatgtaccacgacacgaagaagagggtgagcaccaggagggccttcaccccaaggccgccgcgccgcgcctgaccagcctccttcagccttgcaagggcccggcgcttcaactcagggtagaaatcggactctccccaagcatagaacgtcttggggtcctgcagcgtaccaatgcggtacttctccatcaccttgtccgggcgcccagcagggtggtatgactcgacgaggattgtgcagtcccttccaaggcccagcgtgatgacaccgccaccagggtgcttggcaaggaaatcagtgacatcgtagactccttcgtggcacgtcagccagccatcggtggggaggatgtgccgcctcacctcatcggtggtgaacagccgctccttgccctgccccgacactgccagggagtcgtagtacgtggccggcgggagtccagctggacgggcgggccgaacgttggcggtgtcattctctcgcttttccaccgtgccgttctcgcaaggttgcggcttcgctccgttctcaggggtggctccgttctccggcttgccgttcttttgggagtattgcttgacatagaaattgccaaacagcaccaacatattgaccatcacgaacgactgcaaagcagtcagaggccgtgggtagatctctgacccgcaaatccacacataaatggaatgtgtaaaacagaaacagaattgaaccatctggagctgtgtcaagatcttcttccatgggcaactgatgccaaaagttgcaagcaagtagtaagagtacatcaggacatggatggaagaattgtagcaagctccaaaccagccatcacctccaggtgcgaaatacacaacagcaaaccaagcccatgtcaacagggcatgatgatacacgtgaaggaaagaaatctggttgttcttctttcgcagcaccataaaaagtgtatcaaaatattccacatacttgttgtggtagtgggcataaatgaagaagccaatgcccaaaccttttgggcttcggtcgacaccacttccccaaaagcgcatcccagtggcatgcacctggtacaagaatcccaacacgatgcaaaggttcatcaaggtctgatacaggttatacgcaaacatgtatgttttgatctcaaagggttcacggttcttcatccagcggcaccccacgaagatcattgataagtataaaccggacataatgagaggagtccaaacagaatcagcataggccgaaatgctgccctcctgttgtgcctgcttccagacatgtcccaaaacggcaaggtccaaagccatcagtgaaaggggtttccacatggtgctgaggttgatgactgggctatccgccattgtgcaggcaatacaatgcgccgcaccgaaaaaaaa

SEQ ID NO: 21 - DNA, 2382 bp, Euglena gracilis
atggcggatagcccagtcatcaacctcagcaccatgtggaaacccctttcactgatggctttggaccttgccattttgggacatgtctggaagcaggcacaacaggagggcagcatttcggcctatgctgattctgtttggactcctctcattatgtccgttttatacttatcaatgatcttcgtggggtgccgctggatgaagaaccgtgaaccctttgagatcaaaacatacatgtttgcgtataacctgtatcagaccttgatgaacctttgcatcgtgttgggattcttgtaccaggtgcatgccactgggatgcgcttttggggaagtggtgtcgaccgaagcccgaaaggtttgggcattggcttcttcatttatgcccactaccacaacaagtatgtggaatattttgatacactttttatggtgctgcgaaagaagaacaaccagatttctttccttcacgtgtatcatcatgccctgttgacatgggcttggtttgctgttgtgtatttcgcacctggaggtgatggctggtttggagcttgctacaattcttccatccatgtcctgatgtactcttactacttgcttgcaacttttggcatcagttgcccatggaagaagatcttgacacagctccagatggttcaattctgtttctgttttacacattccatttatgtgtggatttgcgggtcagagatctacccacggcctctgactgctttgcagtcgttcgtgatggtcaatatgttggtgctgtttggcaatttctatgtcaagcaatactcccaaaagaacggcaagccggagaacggagccacccctgagaacggagcgaagccgcaaccttgcgagaacggcacggtggaaaagcgagagaatgacaccgccaacgttcggcccacccgtccagctggacccccgccggccacgtactacgactccctggcagtgtcggggcagggcaaggagcggctgttcaccaccgatgaggtgaggcggcacatcctccccaccgatggctggctgacgtgccacgaaggagtctacgatgtcactgatttccttgccaagcaccctggtggcggtgtcatcacgctgggccttggaagggactgcacaatcctcatcgagtcataccaccctgctgggcgcccggacaaggtgatggagaagtaccgcattggtacgctgcaggaccccaagacgttctatgcttggggagagtccgatttctaccctgagttgaagcgccgggcccttgcaaggctgaaggaggctggtcaggcgcggcgcggcggccttggggtgaaggccctcctggtgctcaccctcttcttcgtgtcgtggtacatgtgggtggcccacaagtccttcctctgggccgccgtctggggcttcgccggctcccacgtcgggctgagcatccagcacgatggcaaccacggcgcgttcagccgcaacacactggtgaaccgcctggcggggtggggcatggacttgatcggcgcgtcgtccacggtgtgggagtaccagcacgtcatcggccaccaccagtacaccaacctcgtgtcggacacgctattcagtctgcctgagaacgatccggacgtcttctccagctacccgctgatgcgcatgcacccggatacggcgtggcagccgcaccaccgcttccagcacctgttcgcgttcccactgttcgccctgatgacaatcagcaaggtgctgaccagcgatttcgctgtctgcctcagcatgaagaaggggtccatcgactgctcctccaggctcgtcccactggaggggcagctgctgttctggggggccaagctggcgaacttcctgttgcagattgtgttgccatgctacctccacgggacagctatgggcctggccctcttctctgttgctcaccttgtgtcgggggagtacctcgcgatctgcttcatcatcaaccacatcagcgagtcttgtgagtttatgaatacaagctttcaaaccgccgcccggaggacagagatgcttcaggcagcacatcaggcagcggaggccaagaaggtgaagcccacccctccaccgaacgattgggctgtgacacaggtccaatgctgcgtgaattggagatcaggtggcgtgttggccaatcacctctctggaggcttgaaccaccagatcgagcatcatctgttccccagcatctcgcatgccaactaccccaccatcgcccctgttgtgaaggaggtgtgcgaggagtacgggttgccgtacaagaattacgtcacgttctgggatgcagtctgtggcatggttcagcacctccggttgatgggtgctccaccggtgccaacgaacggggacaaaaagtcataa

SEQ ID NO: 22 - protein, 793 aa, Euglena gracilis
MADSPVINLSTMWKPLSLMALDLAILGHVWKQAQQEGSISAYADSVWTPLIMSVLYLSMIFVGCRWMKNREPFEIKTYMFAYNLYQTLMNLCIVLGFLYQVHATGMRFWGSGVDRSPKGLGIGFFIYAHYHNKYVEYFDTLFMVLRKKNNQISFLHVYHHALLTWAWFAVVYFAPGGDGWFGACYNSSIHVLMYSYYLLATFGISCPWKKILTQLQMVQFCFCFTHSIYVWICGSEIYPRPLTALQSFVMVNMLVLFGNFYVKQYSQKNGKPENGATPENGAKPQPCENGTVEKRENDTANVRPTRPAGPPPATYYDSLAVSGQGKERLFTTDEVRRHILPTDGWLTCHEGVYDVTDFLAKHPGGGVITLGLGRDCTILIESYHPAGRPDKVMEKYRIGTLQDPKTFYAWGESDFYPELKRRALARLKEAGQARRGGLGVKALLVLTLFFVSWYMWVAHKSFLWAAVWGFAGSHVGLSIQHDGNHGAFSRNTLVNRLAGWGMDLIGASSTVWEYQHVIGHHQYTNLVSDTLFSLPENDPDVFSSYPLMRMHPDTAWQPHHRFQHLFAFPLFALMTISKVLTSDFAVCLSMKKGSIDCSSRLVPLEGQLLFWGAKLANFLLQIVLPCYLHGTAMGLALFSVAHLVSGEYLAICFIINHISESCEFMNTSFQTAARRTEMLQAAHQAAEAKKVKPTPPPNDWAVTQVQCCVNWRSGGVLANHLSGGLNHQIEHHLFPSISHANYPTIAPVVKEVCEEYGLPYKNYVTFWDAVCGMVQHLRLMGAPPVPTNGDKKS

SEQ ID NO: 23 - DNA, 2569 bp, Euglena gracilis
gcggccgctagacatgccaccagttgtggtatggttaaccgaatatgaacaaacacccgattccagtccaagattgctcaataaggaacagggtgggggagcaacttgtgagagtttcgacgccatgggtgcctacagattaagtagatccttcttgtccaacttgttgaccttgcgctcggcacattctgagagctggtttcgcagccggtagatttcgtcgttggcctgttgcaactgggtccgcagctcggagtcgcaaagattgttcgctgtgaggatctcagcacggatttcttctaattcagaagccgcagcacggagttgattcccaagggtatcaaggcggccatatgcttgctccaataatttctcaacacggtcgggggtgatgctcagcttaacagattcttctggtggttttggaagctctccagcaggctccacggggggcgcagggggcgcggcgggaaccagtggaagagttggcaacgtcgacagggggtactgtgcttgagggccaggaatcacggacgggacttgcggaatgtaagatggaccagtaggaaatgacggaaatgttcgagcaaatccgccaaaacccgtgtacgcaggtgccggggcgtaattaacaatcgacagcggccgcgaattcgcggccgctcacattccatttatgtgtggatttgcgggtcagagatctacccacggcctctgactgctttgcagtcgttcgtgatggtcaatatgttggtgctgtttggcaatttctatgtcaagcaatactcccaaaagaacggcaagccggagaacggagccacccctgagaacggagcgaagccgcaaccttgcgagaacggcacggtggaaaagcgagagaatgacaccgccaacgttcggcccacccgtccagctggacccccgccggccacgtactacgactccctggcagtgtcggggcagggcaaggagcggctgttcaccaccgatgaggtgaggcggcacatcctccccaccgatggctggctgacgtgccacgaaggagtctacgatgtcactgatttccttgccaagcaccctggtggcggtgtcatcacgctgggccttggaagggactgcacaatcctcatcgagtcataccaccctgctgggcgcccggacaaggtgatggagaagtaccgcattggtacgctgcaggaccccaagacgttctatgcttggggagagtccgatttctaccctgagttgaagcgccgggcccttgcaaggctgaaggaggctggtcaggcgcggcgcggcggccttggggtgaaggccctcctggtgctcaccctcttcttcgtgtcgtggtacatgtgggtggcccacaagtccttcctctgggccgccgtctggggcttcgccggctcccacgtcgggctgagcatccagcacgatggcaaccacggcgcgttcagccgcaacacactggtgaaccgcctggcggggtggggcatggacttgatcggcgcgtcgtccacggtgtgggagtaccagcacgtcatcggccaccaccagtacaccaacctcgtgtcggacacgctattcagtctgcctgagaacgatccggacgtcttctccagctacccgctgatgcgcatgcacccggatacggcgtggcagccgcaccaccgcttccagcacctgttcgcgttcccactgttcgccctgatgacaatcagcaaggtgctgaccagcgatttcgctgtctgcctcagcatgaagaaggggtccatcgactgctcctccaggctcgtcccactggaggggcagctgctgttctggggggccaagctggcgaacttcctgttgcagattgtgttgccatgctacctccacgggacagctatgggcctggccctcttctctgttgctcaccttgtgtcgggggagtacctcgcgatctgcttcatcatcaaccacatcagcgagtcttgtgagtttatgaatacaagctttcaaaccgccgcccggaggacagagatgcttcaggcagcacatcaggcagcggaggccaagaaggtgaagcccacccctccaccgaacgattgggctgtgacacaggtccaatgctgcgtgaattggagatcaggtggcgtgttggccaatcacctctctggaggcttgaaccaccagatcgagcatcatctgttccccagcatctcgcatgccaactaccccaccatcgcccctgttgtgaaggaggtgtgcgaggagtacgggttgccgtacaagaattacgtcacgttctgggatgcagtctgtggcatggttcagcacctccggttgatgggtgctccaccggtgccaacgaacggggacaaaaagtcataagccacgacatcatttggggctcactccgtgcagccttttcttgggctgcccacgaagatgcgcgatgaggcacctggtggttgccctccgccggcctcggaaaacggttcgacgcctgctccttcagcccagagcactccggcgaagagtgaaagagcactgacctgaattttatgatgacccatttagcggccgc

SEQ ID NO: 24 - DNA, 1626 bp, Euglena gracilis
atgttggtgctgtttggcaatttctatgtcaagcaatactcccaaaagaacggcaagccggagaacggagccacccctgagaacggagcgaagccgcaaccttgcgagaacggcacggtggaaaagcgagagaatgacaccgccaacgttcggcccacccgtccagctggacccccgccggccacgtactacgactccctggcagtgtcggggcagggcaaggagcggctgttcaccaccgatgaggtgaggcggcacatcctccccaccgatggctggctgacgtgccacgaaggagtctacgatgtcactgatttccttgccaagcaccctggtggcggtgtcatcacgctgggccttggaagggactgcacaatcctcatcgagtcataccaccctgctgggcgcccggacaaggtgatggagaagtaccgcattggtacgctgcaggaccccaagacgttctatgcttggggagagtccgatttctaccctgagttgaagcgccgggcccttgcaaggctgaaggaggctggtcaggcgcggcgcggcggccttggggtgaaggccctcctggtgctcaccctcttcttcgtgtcgtggtacatgtgggtggcccacaagtccttcctctgggccgccgtctggggcttcgccggctcccacgtcgggctgagcatccagcacgatggcaaccacggcgcgttcagccgcaacacactggtgaaccgcctggcggggtggggcatggacttgatcggcgcgtcgtccacggtgtgggagtaccagcacgtcatcggccaccaccagtacaccaacctcgtgtcggacacgctattcagtctgcctgagaacgatccggacgtcttctccagctacccgctgatgcgcatgcacccggatacggcgtggcagccgcaccaccgcttccagcacctgttcgcgttcccactgttcgccctgatgacaatcagcaaggtgctgaccagcgatttcgctgtctgcctcagcatgaagaaggggtccatcgactgctcctccaggctcgtcccactggaggggcagctgctgttctggggggccaagctggcgaacttcctgttgcagattgtgttgccatgctacctccacgggacagctatgggcctggccctcttctctgttgctcaccttgtgtcgggggagtacctcgcgatctgcttcatcatcaaccacatcagcgagtcttgtgagtttatgaatacaagctttcaaaccgccgcccggaggacagagatgcttcaggcagcacatcaggcagcggaggccaagaaggtgaagcccacccctccaccgaacgattgggctgtgacacaggtccaatgctgcgtgaattggagatcaggtggcgtgttggccaatcacctctctggaggcttgaaccaccagatcgagcatcatctgttccccagcatctcgcatgccaactaccccaccatcgcccctgttgtgaaggaggtgtgcgaggagtacgggttgccgtacaagaattacgtcacgttctgggatgcagtctgtggcatggttcagcacctccggttgatgggtgctccaccggtgccaacgaacggggacaaaaagtcataa

SEQ ID NO: 25 - protein, 300 aa, Ostreococcus tauri
MSASGALLPAIASAAYAYATYAYAFEWSHANGIDNVDAREWIGALSLRLPAIATTMYLLFCLVGPRLMAKREAFDPKGFMLAYNAYQTAFNVVVLGMFAREISGLGQPVWGSTMPWSDRKSFKILLGVWLHYNNKYLELLDTVFMVARKKTKQLSFLHVYHHALLIWAWWLVCHLMATNDCIDAYFGAACNSFIHIVMYSYYLMSALGIRCPWKRYITQAQMLQFVIVFAHAVFVLRQKHCPVTLPWAQMFVMTNMLVLFGNFYLKAYSNKSRGDGASSVKPAETTRAPSVRRTRSRKID

SEQ ID NO: 26 - protein, 358 aa, Thalassiosira pseudonana
MCSSPPSQSKTTSLLARYTTAALLLLTLTTWCHFAFPAATATPGLTAEMHSYKVPLGLTVFYLLSLPSLKYVTDNYLAKKYDMKSLLTESMVLYNVAQVLLNGWTVYAIVDAVMNRDHPFIGSRSLVGAALHSGSSYAVWVHYCDKYLEFFDTYFMVLRGKMDQVSFLHIYHHTTIAWAWWIALRFSPGGDIYFGALLNSIIHVLMYSYYALALLKVSCPWKRYLTQAQLLQFTSVVVYTGCTGYTHYYHTKHGADETQPSLGTYYFCCGVQVFEMVSLFVLFSIFYKRSYSKKNKSGGKDSKKNDDGNNEDQCHKAMKDISEGAKEVVGHAAKDAGKLVATASKAVKRKGTRVTGAM

SEQ ID NO: 27 - protein, 515 aa, Thraustochytrium aureum
  MISC_FEATURE (1)..(515): NCBI Accession No. AAN75707(GI 25956288), locus AAN75707, CDS AF391543
MTVGFDETVTMDTVRNHNMPDDAWCAIHGTVYDITKFSKVHPGGDIIMLAAGKEATILFETYHIKGVPDAVLRKYKVGKLPQGKKGETSHMPTGLDSASYYSWDSEFYRVLRERVAKKLAEPGLMQRARMELWAKAIFLLAGFWGSLYAMCVLDPHGGAMVAAVTLGVFAAFVGTCIQHDGSHGAFSKSRFMNKAAGWTLDMIGASAMTWEMQHVLGHHPYTNLIEMENGLAKVKGADVDPKKVDQESDPDVFSTYPMLRLHPWHRQRFYHKFQHLYAPLIFGFMTINKVISQDVGVVLRKRLFQIDANCRYGSPWNVARFWIMKLLTTLYMVALPMYMQGPAQGLKLFFMAHFTCGEVLATMFIVNHIIEGVSYASKDAVKGVMAPPRTVHGVTPMQVTQKALSAAESTKSDADKTTMIPLNDWAAVQCQTSVNWAVGSWFWNHFSGGLNHQIEHHCFPQNPHTVNVYISGIVKETCEEYGVPYQAEISLFSAYFKMLSHLRTLGNEDLTAWST

SEQ ID NO: 28 - protein, 509 aa, Schizochytrium aggregatum
MTVGGDEVYSMAQVRDHNTPDDAWCAIHGEVYELTKFARTHPGGDIILLAAGKEATILFETYHVRPISDAVLRKYRIGKLAAAGKDEPANDSTYYSWDSDFYKVLRQRVVARLEERKIARRGGPEIWIKAAILVSGFWSMLYLMCTLDPNRGAILAAIALGIVAAFVGTCIQHDGNHGAFAFSPFMNKLSGWTLDMIGASAMTWEMQHVLGHHPYTNLIEMENGTQKVTHADVDPKKADQESDPDVFSTYPMLRLHPWHRKRFYHRFQHLYAPLLFGFMTINKVITQDVGVVLSKRLFQIDANCRYASKSYVARFWIMKLLTVLYMVALPVYTQGLVDGLKLFFIAHFSCGELLATMFIVNHIIEGVSYASKDSVKGTMAPPRTVHGVTPMHDTRDALGKEKAATKHVPLNDWAAVQCQTSVNWSIGSWFWNHFSGGLNHQIEHHLFPGLTHTTYVYIQDVVQATCAEYGVPYQSEQSLFSAYFKMLSHLRALGNEPMPSWEKDHPKSK

SEQ ID NO: 29 - protein, 550 aa, Thalassiosira pseudonana
  MISC_FEATURE (1)..(550): NCBI Accession No. AAX14506 (GI 60173017), locus AAX14506, CDS AY817156
MGNGNLPASTAQLKSTSKPQQQHEHRTISKSELAQHNTPKSAWCAVHSTPATDPSHSNNKQHAHLVLDITDFASRHPGGDLILLASGKDASVLFETYHPRGVPTSLIQKLQIGVMEEEAFRDSFYSWTDSDFYTVLKRRVVERLEERGLDRRGSKEIWIKALFLLVGFWYCLYKMYTTSDIDQYGIAIAYSIGMGTFAAFIGTCIQHDGNHGAFAQNKLLNKLAGWTLDMIGASAFTWELQHMLGHHPYTNVLDGVEEERKERGEDVALEEKDQESDPDVFSSFPLMRMHPHHTTSWYHKYQHLYAPPLFALMTLAKVFQQDFEVATSGRLYHIDANVRYGSVWNVMRFWAMKVITMGYMMGLPIYFHGVLRGVGLFVIGHLACGELLATMFIVNHVIEGVSYGTKDLVGGASHGDEKKIVKPTTVLGDTPMEKTREEALKSNSNNNKKKGEKNSVPSVPFNDWAAVQCQTSVNWSPGSWFWNHFSGGLSHQIEHHLFPSICHTNYCHIQDVVESTCAEYGVPYQSESNLFVAYGKMISHLKFLGKAKCE

SEQ ID NO: 30 - protein, 433 aa, Isochrysis galbana
  MISC_FEATURE (1)..(433): NCBI Accession No. AAV33631 (GI 54307110), locus AAV33631, CDS AY630574
MCNAAQVETQALRAKEAAKPTWTKIHGRTVDVETFRHPGGNILDLFLGMDATTAFETFHGHHKGAWKMLKTLPEKEVAAADIPAQKEEHVAEMTRLMASWRERGLFKPRPVASSIYGLCVIFAIAASVACAPYAPVLAGIAVGTCWAQCGFLQHMGGHREWGRTWSFAFQHLFEGLLKGGSASWWRNRHNKHHAKTNVLGEDGDLRTTPFFAWDPTLAKKVPDWSLRTQAFTFLPALGAYVFVFAFTVRKYSVVKRLWHEVALMVAHYALFSWALSAAGASLSSGLTFYCTGYAWQGIYLGFFFGLSHFAVERVPSTATWLESTMMGTVDWGGSSAFCGYLSGFLNIQIEHHMAPQMPMENLRQIRADCKAAAHKFGLPYRELTFVAATKLMMSGLYRTGKDELKLRADRRKFTRAQAYMGAASALVDTLKAD

SEQ ID NO: 31 - DNA, 9472 bp, Artificial Sequence
  plasmid pDMW263
catggcatggatggtacgtcctgtagaaaccccaacccgtgaaatcaaaaaactcgacggcctgtgggcattcagtctggatcgcgaaaactgtggaattgatcagcgttggtgggaaagcgcgttacaagaaagccgggcaattgctgtgccaggcagttttaacgatcagttcgccgatgcagatattcgtaattatgcgggcaacgtctggtatcagcgcgaagtctttataccgaaaggttgggcaggccagcgtatcgtgctgcgtttcgatgcggtcactcattacggcaaagtgtgggtcaataatcaggaagtgatggagcatcagggcggctatacgccatttgaagccgatgtcacgccgtatgttattgccgggaaaagtgtacgtatcaccgtttgtgtgaacaacgaactgaactggcagactatcccgccgggaatggtgattaccgacgaaaacggcaagaaaaagcagtcttacttccatgatttctttaactatgccgggatccatcgcagcgtaatgctctacaccacgccgaacacctgggtggacgatatcaccgtggtgacgcatgtcgcgcaagactgtaaccacgcgtctgttgactggcaggtggtggccaatggtgatgtcagcgttgaactgcgtgatgcggatcaacaggtggttgcaactggacaaggcactagcgggactttgcaagtggtgaatccgcacctctggcaaccgggtgaaggttatctctatgaactgtgcgtcacagccaaaagccagacagagtgtgatatctacccgcttcgcgtcggcatccggtcagtggcagtgaagggcgaacagttcctgattaaccacaaaccgttctactttactggctttggtcgtcatgaagatgcggacttacgtggcaaaggattcgataacgtgctgatggtgcacgaccacgcattaatggactggattggggccaactcctaccgtacctcgcattacccttacgctgaagagatgctcgactgggcagatgaacatggcatcgtggtgattgatgaaactgctgctgtcggctttaacctctctttaggcattggtttcgaagcgggcaacaagccgaaagaactgtacagcgaagaggcagtcaacggggaaactcagcaagcgcacttacaggcgattaaagagctgatagcgcgtgacaaaaaccacccaagcgtggtgatgtggagtattgccaacgaaccggatacccgtccgcaagtgcacgggaatatttcgccactggcggaagcaacgcgtaaactcgacccgacgcgtccgatcacctgcgtcaatgtaatgttctgcgacgctcacaccgataccatcagcgatctctttgatgtgctgtgcctgaaccgttattacggatggtatgtccaaagcggcgatttggaaacggcagagaaggtactggaaaaagaacttctggcctggcaggagaaactgcatcagccgattatcatcaccgaatacggcgtggatacgttagccgggctgcactcaatgtacaccgacatgtggagtgaagagtatcagtgtgcatggctggatatgtatcaccgcgtctttgatcgcgtcagcgccgtcgtcggtgaacaggtatggaatttcgccgattttgcgacctcgcaaggcatattgcgcgttggcggtaacaagaaagggatcttcactcgcgaccgcaaaccgaagtcggcggcttttctgctgcaaaaacgctggactggcatgaacttcggtgaaaaaccgcagcagggaggcaaacaatgattaattaactagagcggccgccaccgcggcccgagattccggcctcttcggccgccaagcgacccgggtggacgtctagaggtacctagcaattaacagatagtttgccggtgataattctcttaacctcccacactcctttgacataacgatttatgtaacgaaactgaaatttgaccagatattgtgtccgcggtggagctccagcttttgttccctttagtgagggttaatttcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaaccgatttcgacagtaataatttgaatcgaatcggagcctaaaatgaacccgagtatatctcataaaattctcggtgagaggtctgtgactgtcagtacaaggtgccttcattatgccctcaaccttaccatacctcactgaatgtagtgtacctctaaaaatgaaatacagtgccaaaagccaaggcactgagctcgtctaacggacttgatatacaaccaattaaaacaaatgaaaagaaatacagttctttgtatcatttgtaacaattaccctgtacaaactaaggtattgaaatcccacaatattcccaaagtccacccctttccaaattgtcatgcctacaactcatataccaagcactaacctaccaaacaccactaaaaccccacaaaatatatcttaccgaatatacagtaacaagctaccaccacactcgttgggtgcagtcgccagcttaaagatatctatccacatcagccacaactcccttcctttaataaaccgactacacccttggctattgaggttatgagtgaatatactgtagacaagacactttcaagaagactgtttccaaaacgtaccactgtcctccactacaaacacacccaatctgcttcttctagtcaaggttgctacaccggtaaattataaatcatcatttcattagcagggcagggccctttttatagagtcttatacactagcggaccctgccggtagaccaacccgcaggcgcgtcagtttgctccttccatcaatgcgtcgtagaaacgacttactccttcttgagcagctccttgaccttgttggcaacaagtctccgacctcggaggtggaggaagagcctccgatatcggcggtagtgataccagcctcgacggactccttgacggcagcctcaacagcgtcaccggcgggcttcatgttaagagagaacttgagcatcatggcggcagacagaatggtggcaatggggttgaccttctgcttgccgagatcgggggcagatccgtgacagggctcgtacagaccgaacgcctcgttggtgtcgggcagagaagccagagaggcggagggcagcagacccagagaaccggggatgacggaggcctcgtcggagatgatatcgccaaacatgttggtggtgatgatgataccattcatcttggagggctgcttgatgaggatcatggcggccgagtcgatcagctggtggttgagctcgagctgggggaattcgtccttgaggactcgagtgacagtctttcgccaaagtcgagaggaggccagcacgttggccttgtcaagagaccacacgggaagaggggggttgtgctgaagggccaggaaggcggccattcgggcaattcgctcaacctcaggaacggagtaggtctcggtgtcggaagcgacgccagatccgtcatcctcctttcgctctccaaagtagatacctccgacgagctctcggacaatgatgaagtcggtgccctcaacgtttcggatgggggagagatcggcgagcttgggcgacagcagctggcagggtcgcaggttggcgtacaggttcaggtcctttcgcagcttgaggagaccctgctcgggtcgcacgtcggttcgtccgtcgggagtggtccatacggtgttggcagcgcctccgacagcaccgagcataatagagtcagcctttcggcagatgtcgagagtagcgtcggtgatgggctcgccctccttctcaatggcagctcctccaatgagtcggtcctcaaacacaaactcggtgccggaggcctcagcaacagacttgagcaccttgacggcctcggcaatcacctcggggccacagaagtcgccgccgagaagaacaatcttcttggagtcagtcttggtcttcttagtttcgggttccattgtggatgtgtgtggttgtatgtgtgatgtggtgtgtggagtgaaaatctgtggctggcaaacgctcttgtatatatacgcacttttgcccgtgctatgtggaagactaaacctccgaagattgtgactcaggtagtgcggtatcggctagggacccaaaccttgtcgatgccgatagcgctatcgaacgtaccccagccggccgggagtatgtcggaggggacatacgagatcgtcaagggtttgtggccaactggtaaataaatgatgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtac

SEQ ID NO: 32 - DNA, 7879 bp, Artificial Sequence
  plasmid pDMW237
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgactcaggcgacgacggaattcctgcagcccatctgcagaattcaggagagaccgggttggcggcgtatttgtgtcccaaaaaacagccccaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctccatggctctggccaacgacgctggcgagcgaatctgggctgccgtcaccgatcccgaaatcctcattggcaccttctcctacctgctcctgaagcctctcctgcgaaactctggtctcgtggacgagaagaaaggagcctaccgaacctccatgatctggtacaacgtcctcctggctctcttctctgccctgtccttctacgtgactgccaccgctctcggctgggactacggtactggagcctggctgcgaagacagaccggtgatactccccagcctctctttcagtgtccctctcctgtctgggactccaagctgttcacctggactgccaaggccttctactattctaagtacgtggagtacctcgacaccgcttggctggtcctcaagggcaagcgagtgtcctttctgcaggccttccatcactttggagctccctgggacgtctacctcggcattcgactgcacaacgagggtgtgtggatcttcatgttctttaactcgttcattcacaccatcatgtacacctactatggactgactgccgctggctacaagttcaaggccaagcctctgatcactgccatgcagatttgccagttcgtcggtggctttctcctggtctgggactacatcaacgttccctgcttcaactctgacaagggcaagctgttctcctgggctttcaactacgcctacgtcggatctgtctttctcctgttctgtcacttcttttaccaggacaacctggccaccaagaaatccgctaaggctggtaagcagctttagc

SEQ ID NO: 33 - DNA, 7783 bp, Artificial Sequence
  plasmid pY115
catggctctggccaacgacgctggcgagcgaatctgggctgccgtcaccgatcccgaaatcctcattggcaccttctcctacctgctcctgaagcctctcctgcgaaactctggtctcgtggacgagaagaaaggagcctaccgaacctccatgatctggtacaacgtcctcctggctctcttctctgccctgtccttctacgtgactgccaccgctctcggctgggactacggtactggagcctggctgcgaagacagaccggtgatactccccagcctctctttcagtgtccctctcctgtctgggactccaagctgttcacctggactgccaaggccttctactattctaagtacgtggagtacctcgacaccgcttggctggtcctcaagggcaagcgagtgtcctttctgcaggccttccatcactttggagctccctgggacgtctacctcggcattcgactgcacaacgagggtgtgtggatcttcatgttctttaactcgttcattcacaccatcatgtacacctactatggactgactgccgctggctacaagttcaaggccaagcctctgatcactgccatgcagatttgccagttcgtcggtggctttctcctggtctgggactacatcaacgttccctgcttcaactctgacaagggcaagctgttctcctgggctttcaactacgcctacgtcggatctgtctttctcctgttctgtcacttcttttaccaggacaacctggccaccaagaaatccgctaaggctggtaagcagctttagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtac

SEQ ID NO: 34 - DNA, 8704 bp, Artificial Sequence
  plasmid pBY1
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatgatcacaagtttgtacaaaaaagctgaacgagaaacgtaaaatgatataaatatcaatatattaaattagattttgcataaaaaacagactacataatactgtaaaacacaacatatccagtcatattggcggccgcattaggcaccccaggctttacactttatgcttccggctcgtataatgtgtggattttgagttaggatccgtcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaaacgcgtggatccggcttactaaaagccagataacagtatgcgtatttgcgcgctgatttttgcggtataagaatatatactgatatgtatacccgaagtatgtcaaaaagaggtatgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacaggggctggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgaccatagtgactggatatgttgtgttttacagcattatgtagtctgttttttatgcaaaatctaatttaatatattgatatttatatcattttacgtttctcgttcagctttcttgtacaaagtggtgat

SEQ ID NO: 35 - DNA, 19 bp, Artificial Sequence
  primer oYFBA1
acgcagatctactatagag

SEQ ID NO: 36 - DNA, 27 bp, Artificial Sequence
  primer oYFBA1-6
agcggccgctggtaccagagctgggtt

SEQ ID NO: 37 - DNA, 6992 bp, Artificial Sequence
  plasmid pY158
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttagcaaaaagtgaaggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccagc

SEQ ID NO: 38 - DNA, 8707 bp, Artificial Sequence
  plasmid pY159
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttagcaaaaagtgaaggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccagcggccatcacaagtttgtacaaaaaagctgaacgagaaacgtaaaatgatataaatatcaatatattaaattagattttgcataaaaaacagactacataatactgtaaaacacaacatatccagtcatattggcggccgcattaggcaccccaggctttacactttatgcttccggctcgtataatgtgtggattttgagttaggatccgtcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaaacgcgtggatccggcttactaaaagccagataacagtatgcgtatttgcgcgctgatttttgcggtataagaatatatactgatatgtatacccgaagtatgtcaaaaagaggtatgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacaggggctggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgaccatagtgactggatatgttgtgttttacagcattatgtagtctgttttttatgcaaaatctaatttaatatattgatatttatatcattttacgtttctcgttcagctttcttgtacaaagtggtgat

SEQ ID NO: 39 - DNA, 8425 bp, Artificial Sequence
  plasmid pBY-C20elo1
cttgtacaaagtggtgatggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatgatcacaagtttgtacaaaaaagttgggcattgtattgcctgcacaatggcggatagcccagtcatcaacctcagcaccatgtggaaacccctttcactgatgggacatgtctggaagcaggcacaacaggagggcagcatttcggcctatgctgattctgttcggattcctctcattatgtccgttttatacttatcaatgatcttcgtggggtgccgctggatgaagaaccgtgagccctttgagatcaaaacatacatgtttgcgtataacctgtatcagaccttgatgaacctttgcatcgtgttgggattcttgtaccaggtgcatgccactgggatgcgcttttggggaagtggtgtcgaccgaagcccgaaaggtttgggcattggcttcttcatttatgcccactaccacaacaagtatgtggaatattttgatacactttttatggtgctgcgaaagaagaacaaccagatttctttccttcacgtgtatcatcatgccctgttgacatgggcttggtttgctgttgtgtatttcgcacctggaggtgatggctggtttggagcttgctacaattcttccatccatgtcctgatgtactcttactacttgcttgcaacttttggcatcagttgcccatggaagaagatcttgacacagctccagatggttcagttctgtttctgttttacacattccatttatgtgtggatttgcgggtcagagatctacccacggcctctgactgctttgcagtcgttcgtgatggtcaatatgttggtgctgtttggcaatttctatgtcaagcaatactcccaaaagaacggcaagccggagaacggagccacccctgagaacggagcgaagccgcaaccttgcgagaacggcacggtggaaaagcgagaggcgccccgatctgtcggcatgggacgctgaggagtccaaatgcacggaaaggagctagcgatgcctcacgagctaatctgcctcggagtagactcccacatttctcctgctctgtgttttgctctcctcagtccccattggctctccagtgaccgcgctttcccctcttctgtcaagccaccctcctgcatgggttccagcggagcttctgaccgcttcgacattttccttgcgcagccctgcctcacgcagcggacatttttgggcactgcggtgcagtgtttatgtgtcctcccaccccgtcttaccctccccctggcttgctcggaccatccagctcgtttatcctctcctctcctgtggcagcgttgcctcggagtggaaagcttcagataagcatctttcctcctttgcattcaatgctccacaagaaactctcaatgttccaatggttgcaatgttccaaaaaaaaaaaaaaaaaaaaaaaaaaaaacccaacttt

SEQ ID NO: 40 - DNA, 9677 bp, Artificial Sequence
  plasmid py132
cttgtacaaagtggtgatggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatgatcacaagtttgtacaaaaaagttggattttttttcggtgcggcgcattgtattgcctgcacaatggcggatagcccagtcatcaacctcagcaccatgtggaaacccctttcactgatggctttggaccttgccgttttgggacatgtctggaagcaggcacaacaggagggcagcatttcggcctatgctgattctgtttggactcctctcattatgtccggtttatacttatcaatgatcttcgtggggtgccgctggatgaagaaccgtgaaccctttgagatcaaaacatacatgtttgcgtataacctgtatcagaccttgatgaacctttgcatcgtgttgggattcttgtaccaggtgcatgccactgggatgcgcttttggggaagtggtgtcgaccgaagcccaaaaggtttgggcattggcttcttcatttatgcccactaccacaacaagtatgtggaatattttgatacactttttatggtgctgcgaaagaagaacaaccagatttctttccttcacgtgtatcatcatgccctgttgacatgggcttggtttgctgttgtgtatttcgcacctggaggtgatggctggtttggagcttgctacaattcttccatccatgtcctgatgtactcttactacttgcttgcaacttttggcatcagttgcccatggaagaagatcttgacacagctccagatggttcaattctgtttctgttttacacattccatttatgtgtggatttgcgggtcagagatctacccacggcctctgactgctttgcagtcgttcgtgatggtcaatatgttggtgctgtttggcaatttctatgtcaagcaatactcccaaaagaacggcaagccggagaacggagccacccctgagaacggagcgaagccgcaaccttgcgagaacggcacggtggaaaagcgagagaatgacaccgccaacgttcggcccgcccgtccagctggactcccgccggccacgtactacgactccctggcagtgtcggggcagggcaaggagcggctgttcaccaccgatgaggtgaggcggcacatcctccccaccgatggctggctgacgtgccacgaaggagtctacgatgtcactgatttccttgccaagcaccctggtggcggtgtcatcacgctgggccttggaagggactgcacaatcctcgtcgagtcataccaccctgctgggcgcccggacaaggtgatggagaagtaccgcattggtacgctgcaggaccccaagacgttctatgcttggggagagtccgatttctaccctgagttgaagcgccgggcccttgcaaggctgaaggaggctggtcaggcgcggcgcggcggccttggggtgaaggccctcctggtgctcaccctcttcttcgtgtcgtggtacatgtgggtggcccacaagtccttcctctgggccgccgtctggggcttcgccggctcccacgtcgggctgagcatccagcacgacggcaaccacggcgcgttcagccgcagcacactggtgaaccgcctggcggggtggggcatggacttgatcggcgcgtcgtcaacggtgtgggagtaccagcacgtcatcggccaccaccagtacaccaacctcgtgtcggacacgctattcagtctgcctgagaacgatccggacgtcttctccagctacccgctgatgcgcatgcacccggatacggcgtggcagccgcaccaccgcttccagcacctgttcgcgttcccactgttcgccctgatgacaatcagcaaggtgctgaccagcgatttcgctgtctgcctcagcatgaagaaggggtccatcgactgctcctccaggctcgtcccactggaggggcagctgctgttctggggggccaagctggcgaacttcctgttgcagattgtgttgccatgctacctccacgggacagctatgggcctggccctcttctctgttgcccaccttgtgtcgggggagtacctcgcgatctgcttcatcatcaaccacatcagcgagtcttgtgagtttatgaatacaagctttcaaaccgccgcccggaggacagagatgcttcaggcagcccatcaggcagcggaggccaagaaggtgaagcccacccctccaccgaacgattgggctgtgacacaggtccaatgctgcgtgaattggagatcaggtggcgtgttggccaatcacctctctggaggcttgaaccaccagatcgagcatcatctgttccccagcatctcgcatgccaactaccccatcatcgcccgtgttgtgaaggaggtgtgcgaggagtatgggttgccgtacaagaactacgtcacgttctgggatgcagtctgtggcatggttcagcacctccggttgatgggtgctccaccggtgccaacgaacggggacaaaaagtcataagccacgacatcatttggggctcactccgtgcagccttttcttgggctgcccacgaagatgcgcgatgaggcacctggtggttgccctccgccggcctcggaaaacggttcgacgcctgctccttcagcccagagcactccggcgaagagtgaaagagcactgacctgaattttatgatgacccatttttttaaaaaaaaaaaaaaaaaaaaacccaacttt

SEQ ID NO: 41 - DNA, 9680 bp, Artificial Sequence
  plasmid pY161
cttgtacaaagtggtgatggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttagcaaaaagtgaaggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccagcggccatcacaagtttgtacaaaaaagttggattttttttcggtgcggcgcattgtattgcctgcacaatggcggatagcccagtcatcaacctcagcaccatgtggaaacccctttcactgatggctttggaccttgccgttttgggacatgtctggaagcaggcacaacaggagggcagcatttcggcctatgctgattctgtttggactcctctcattatgtccggtttatacttatcaatgatcttcgtggggtgccgctggatgaagaaccgtgaaccctttgagatcaaaacatacatgtttgcgtataacctgtatcagaccttgatgaacctttgcatcgtgttgggattcttgtaccaggtgcatgccactgggatgcgcttttggggaagtggtgtcgaccgaagcccaaaaggtttgggcattggcttcttcatttatgcccactaccacaacaagtatgtggaatattttgatacactttttatggtgctgcgaaagaagaacaaccagatttctttccttcacgtgtatcatcatgccctgttgacatgggcttggtttgctgttgtgtatttcgcacctggaggtgatggctggtttggagcttgctacaattcttccatccatgtcctgatgtactcttactacttgcttgcaacttttggcatcagttgcccatggaagaagatcttgacacagctccagatggttcaattctgtttctgttttacacattccatttatgtgtggatttgcgggtcagagatctacccacggcctctgactgctttgcagtcgttcgtgatggtcaatatgttggtgctgtttggcaatttctatgtcaagcaatactcccaaaagaacggcaagccggagaacggagccacccctgagaacggagcgaagccgcaaccttgcgagaacggcacggtggaaaagcgagagaatgacaccgccaacgttcggcccgcccgtccagctggactcccgccggccacgtactacgactccctggcagtgtcggggcagggcaaggagcggctgttcaccaccgatgaggtgaggcggcacatcctccccaccgatggctggctgacgtgccacgaaggagtctacgatgtcactgatttccttgccaagcaccctggtggcggtgtcatcacgctgggccttggaagggactgcacaatcctcgtcgagtcataccaccctgctgggcgcccggacaaggtgatggagaagtaccgcattggtacgctgcaggaccccaagacgttctatgcttggggagagtccgatttctaccctgagttgaagcgccgggcccttgcaaggctgaaggaggctggtcaggcgcggcgcggcggccttggggtgaaggccctcctggtgctcaccctcttcttcgtgtcgtggtacatgtgggtggcccacaagtccttcctctgggccgccgtctggggcttcgccggctcccacgtcgggctgagcatccagcacgacggcaaccacggcgcgttcagccgcagcacactggtgaaccgcctggcggggtggggcatggacttgatcggcgcgtcgtcaacggtgtgggagtaccagcacgtcatcggccaccaccagtacaccaacctcgtgtcggacacgctattcagtctgcctgagaacgatccggacgtcttctccagctacccgctgatgcgcatgcacccggatacggcgtggcagccgcaccaccgcttccagcacctgttcgcgttcccactgttcgccctgatgacaatcagcaaggtgctgaccagcgatttcgctgtctgcctcagcatgaagaaggggtccatcgactgctcctccaggctcgtcccactggaggggcagctgctgttctggggggccaagctggcgaacttcctgttgcagattgtgttgccatgctacctccacgggacagctatgggcctggccctcttctctgttgcccaccttgtgtcgggggagtacctcgcgatctgcttcatcatcaaccacatcagcgagtcttgtgagtttatgaatacaagctttcaaaccgccgcccggaggacagagatgcttcaggcagcccatcaggcagcggaggccaagaaggtgaagcccacccctccaccgaacgattgggctgtgacacaggtccaatgctgcgtgaattggagatcaggtggcgtgttggccaatcacctctctggaggcttgaaccaccagatcgagcatcatctgttccccagcatctcgcatgccaactaccccatcatcgcccgtgttgtgaaggaggtgtgcgaggagtatgggttgccgtacaagaactacgtcacgttctgggatgcagtctgtggcatggttcagcacctccggttgatgggtgctccaccggtgccaacgaacggggacaaaaagtcataagccacgacatcatttggggctcactccgtgcagccttttcttgggctgcccacgaagatgcgcgatgaggcacctggtggttgccctccgccggcctcggaaaacggttcgacgcctgctccttcagcccagagcactccggcgaagagtgaaagagcactgacctgaattttatgatgacccatttttttaaaaaaaaaaaaaaaaaaaaacccaacttt

SEQ ID NO: 42 - DNA, 9701 bp, Artificial Sequence
  plasmid pY164
cttgtacaaagtggtgatggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttagcaaaaagtgaaggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccagcggccatcacaagtttgtacaaaaaagttgggtctattttttttcggtgcggcgcattgtattgcctgcacaatggcggatagcccagtcatcaacctcagcaccatgtggaaacccctttcactgatggctttggaccttgccattttgggacatgtctggaagcaggcacaacaggagggcagcatttcggcctatgctgattctgtttggactcctctcattatgtccgttttatacttatcaatgatcttcgtggggtgccgctggatgaagaaccgtgaaccctttgagatcaaaacatacatgtttgcgtataacctgtatcagaccttgatgaacctttgcatcgtgttgggattcttgtaccaggtgcatgccactgggatgcgcttttggggaagtggtgtcgaccgaagcccgaaaggtttgggcattggcttcttcatttatgcccactaccacaacaagtatgtggaatattttgatacactttttatggtgctgcgaaagaagaacaaccagatttctttccttcacgtgtatcatcatgccctgttgacatgggcttggtttgctgttgtgtatttcgcacctggaggtgatggctggtttggagcttgctacaattcttccatccatgtcctgatgtactcttactacttgcttgcaacttttggcatcagttgcccatggaagaagatcttgacacagctccagatggttcaattctgtttctgttttacacattccatttatgtgtggatttgcgggtcagagatctacccacggcctctgactgctttgcagtcgttcgtgatggtcaatatgttggtgctgtttggcaatttctatgtcaagcaatactcccaaaagaacggcaagccggagaacggagccacccctgagaacggagcgaagccgcaaccttgcgagaacggcacggtggaaaagcgagagaatgacaccgccaacgttcggcccacccgtccagctggacccccgccggccacgtactacgactccctggcagtgtcggggcagggcaaggagcggctgttcaccaccgatgaggtgaggcggcacatcctccccaccgatggctggctgacgtgccacgaaggagtctacgatgtcactgatttccttgccaagcaccctggtggcggtgtcatcacgctgggccttggaagggactgcacaatcctcatcgagtcataccaccctgctgggcgcccggacaaggtgatggagaagtaccgcattggtacgctgcaggaccccaagacgttctatgcttggggagagtccgatttctaccctgagttgaagcgccgggcccttgcaaggctgaaggaggctggtcaggcgcggcgcggcggccttggggtgaaggccctcctggtgctcaccctcttcttcgtgtcgtggtacatgtgggtggcccacaagtccttcctctgggccgccgtctggggcttcgccggctcccacgtcgggctgagcatccagcacgatggcaaccacggcgcgttcagccgcaacacactggtgaaccgcctggcggggtggggcatggacttgatcggcgcgtcgtccacggtgtgggagtaccagcacgtcatcggccaccaccagtacaccaacctcgtgtcggacacgctattcagtctgcctgagaacgatccggacgtcttctccagctacccgctgatgcgcatgcacccggatacggcgtggcagccgcaccaccgcttccagcacctgttcgcgttcccactgttcgccctgatgacaatcagcaaggtgctgaccagcgatttcgctgtctgcctcagcatgaagaaggggtccatcgactgctcctccaggctcgtcccactggaggggcagctgctgttctggggggccaagctggcgaacttcctgttgcagattgtgttgccatgctacctccacgggacagctatgggcctggccctcttctctgttgctcaccttgtgtcgggggagtacctcgcgatctgcttcatcatcaaccacatcagcgagtcttgtgagtttatgaatacaagctttcaaaccgccgcccggaggacagagatgcttcaggcagcacatcaggcagcggaggccaagaaggtgaagcccacccctccaccgaacgattgggctgtgacacaggtccaatgctgcgtgaattggagatcaggtggcgtgttggccaatcacctctctggaggcttgaaccaccagatcgagcatcatctgttccccagcatctcgcatgccaactaccccaccatcgcccctgttgtgaaggaggtgtgcgaggagtacgggttgccgtacaagaattacgtcacgttctgggatgcagtctgtggcatggttcagcacctccggttgatgggtgctccaccggtgccaacgaacggggacaaaaagtcataagccacgacatcatttggggctcactccgtgcagccttttcttgggctgcccacgaagatgcgcgatgaggcacctggtggttgccctccgccggcctcggaaaacggttcgacgcctgctccttcagcccagagcactccggcgaagagtgaaagagcactgacctgaattttatgatgacccatttttttatttgcaggcttaaaaaaaaaaaaaaaaaaaaaaaaaacccaacttt

SEQ ID NO: 43 - DNA, 36 bp, Artificial Sequence
  primer EgEPAEloDom-5
gcggccgcaccatggcggatagcccagtcatcaacc

SEQ ID NO: 44 - DNA, 32 bp, Artificial Sequence
  primer oEUG el4-3
tgcggccgcttatgactttttgtccccgttcg

SEQ ID NO: 45 - DNA, 5914 bp, Artificial Sequence
  plasmid pKR1062
ttgtaatacgactcactatagggcgaattgggccctctagatgcatgctcgagcggccgccagtgtgatggatatctgcagaattcagggcggccgcaccatggcggatagcccagtcatcaacctcagcaccatgtggaaacccctttcactgatggctttggaccttgccgttttgggacatgtctggaagcaggcacaacaggagggcagcatttcggcctatgctgattctgtttggactcctctcattatgtccggtttatacttatcaatgatcttcgtggggtgccgctggatgaagaaccgtgaaccctttgagatcaaaacatacatgtttgcgtataacctgtatcagaccttgatgaacctttgcatcgtgttgggattcttgtaccaggtgcatgccactgggatgcgcttttggggaagtggtgtcgaccgaagcccaaaaggtttgggcattggcttcttcatttatgcccactaccacaacaagtatgtggaatattttgatacactttttatggtgctgcgaaagaagaacaaccagatttctttccttcacgtgtatcatcatgccctgttgacatgggcttggtttgctgttgtgtatttcgcacctggaggtgatggctggtttggagcttgctacaattcttccatccatgtcctgatgtactcttactacttgcttgcaacttttggcatcagttgcccatggaagaagatcttgacacagctccagatggttcaattctgtttctgttttacacattccatttatgtgtggatttgcgggtcagagatctacccacggcctctgactgctttgcagtcgttcgtgatggtcaatatgttggtgctgtttggcaatttctatgtcaagcaatactcccaaaagaacggcaagccggagaacggagccacccctgagaacggagcgaagccgcaaccttgcgagaacggcacggtggaaaagcgagagaatgacaccgccaacgttcggcccgcccgtccagctggactcccgccggccacgtactacgactccctggcagtgtcggggcagggcaaggagcggctgttcaccaccgatgaggtgaggcggcacatcctccccaccgatggctggctgacgtgccacgaaggagtctacgatgtcactgatttccttgccaagcaccctggtggcggtgtcatcacgctgggccttggaagggactgcacaatcctcgtcgagtcataccaccctgctgggcgcccggacaaggtgatggagaagtaccgcattggtacgctgcaggaccccaagacgttctatgcttggggagagtccgatttctaccctgagttgaagcgccgggcccttgcaaggctgaaggaggctggtcaggcgcggcgcggcggccttggggtgaaggccctcctggtgctcaccctcttcttcgtgtcgtggtacatgtgggtggcccacaagtccttcctctgggccgccgtctggggcttcgccggctcccacgtcgggctgagcatccagcacgacggcaaccacggcgcgttcagccgcagcacactggtgaaccgcctggcggggtggggcatggacttgatcggcgcgtcgtcaacggtgtgggagtaccagcacgtcatcggccaccaccagtacaccaacctcgtgtcggacacgctattcagtctgcctgagaacgatccggacgtcttctccagctacccgctgatgcgcatgcacccggatacggcgtggcagccgcaccaccgcttccagcacctgttcgcgttcccactgttcgccctgatgacaatcagcaaggtgctgaccagcgatttcgctgtctgcctcagcatgaagaaggggtccatcgactgctcctccaggctcgtcccactggaggggcagctgctgttctggggggccaagctggcgaacttcctgttgcagattgtgttgccatgctacctccacgggacagctatgggcctggccctcttctctgttgcccaccttgtgtcgggggagtacctcgcgatctgcttcatcatcaaccacatcagcgagtcttgtgagtttatgaatacaagctttcaaaccgccgcccggaggacagagatgcttcaggcagcccatcaggcagcggaggccaagaaggtgaagcccacccctccaccgaacgattgggctgtgacacaggtccaatgctgcgtgaattggagatcaggtggcgtgttggccaatcacctctctggaggcttgaaccaccagatcgagcatcatctgttccccagcatctcgcatgccaactaccccatcatcgcccgtgttgtgaaggaggtgtgcgaggagtatgggttgccgtacaagaactacgtcacgttctgggatgcagtctgtggcatggttcagcacctccggttgatgggtgctccaccggtgccaacgaacggggacaaaaagtcataagcggccgcacctgaattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaa

SEQ ID NO: 46 - DNA, 45 bp, Artificial Sequence; identical to SEQ ID NO: 16
  oligonucleotide EgEloD4Mut-5

SEQ ID NO: 47 - DNA, 45 bp, Artificial Sequence
  oligonucleotide EgEloD4Mut-3
gctgtgtcaagatcttcttccaagggcaactgatgccaaaagttg

SEQ ID NO: 48 - DNA, 5914 bp, Artificial Sequence
  plasmid pLF115-7
ttgtaatacgactcactatagggcgaattgggccctctagatgcatgctcgagcggccgccagtgtgatggatatctgcagaattcagggcggccgcaccatggcggatagcccagtcatcaacctcagcaccatgtggaaacccctttcactgatggctttggaccttgccgttttgggacatgtctggaagcaggcacaacaggagggcagcatttcggcctatgctgattctgtttggactcctctcattatgtccggtttatacttatcaatgatcttcgtggggtgccgctggatgaagaaccgtgaaccctttgagatcaaaacatacatgtttgcgtataacctgtatcagaccttgatgaacctttgcatcgtgttgggattcttgtaccaggtgcatgccactgggatgcgcttttggggaagtggtgtcgaccgaagcccaaaaggtttgggcattggcttcttcatttatgcccactaccacaacaagtatgtggaatattttgatacactttttatggtgctgcgaaagaagaacaaccagatttctttccttcacgtgtatcatcatgccctgttgacatgggcttggtttgctgttgtgtatttcgcacctggaggtgatggctggtttggagcttgctacaattcttccatccatgtcctgatgtactcttactacttgcttgcaacttttggcatcagttgcccttggaagaagatcttgacacagctccagatggttcaattctgtttctgttttacacattccatttatgtgtggatttgcgggtcagagatctacccacggcctctgactgctttgcagtcgttcgtgatggtcaatatgttggtgctgtttggcaatttctatgtcaagcaatactcccaaaagaacggcaagccggagaacggagccacccctgagaacggagcgaagccgcaaccttgcgagaacggcacggtggaaaagcgagagaatgacaccgccaacgttcggcccgcccgtccagctggactcccgccggccacgtactacgactccctggcagtgtcggggcagggcaaggagcggctgttcaccaccgatgaggtgaggcggcacatcctccccaccgatggctggctgacgtgccacgaaggagtctacgatgtcactgatttccttgccaagcaccctggtggcggtgtcatcacgctgggccttggaagggactgcacaatcctcgtcgagtcataccaccctgctgggcgcccggacaaggtgatggagaagtaccgcattggtacgctgcaggaccccaagacgttctatgcttggggagagtccgatttctaccctgagttgaagcgccgggcccttgcaaggctgaaggaggctggtcaggcgcggcgcggcggccttggggtgaaggccctcctggtgctcaccctcttcttcgtgtcgtggtacatgtgggtggcccacaagtccttcctctgggccgccgtctggggcttcgccggctcccacgtcgggctgagcatccagcacgacggcaaccacggcgcgttcagccgcagcacactggtgaaccgcctggcggggtggggcatggacttgatcggcgcgtcgtcaacggtgtgggagtaccagcacgtcatcggccaccaccagtacaccaacctcgtgtcggacacgctattcagtctgcctgagaacgatccggacgtcttctccagctacccgctgatgcgcatgcacccggatacggcgtggcagccgcaccaccgcttccagcacctgttcgcgttcccactgttcgccctgatgacaatcagcaaggtgctgaccagcgatttcgctgtctgcctcagcatgaagaaggggtccatcgactgctcctccaggctcgtcccactggaggggcagctgctgttctggggggccaagctggcgaacttcctgttgcagattgtgttgccatgctacctccacgggacagctatgggcctggccctcttctctgttgcccaccttgtgtcgggggagtacctcgcgatctgcttcatcatcaaccacatcagcgagtcttgtgagtttatgaatacaagctttcaaaccgccgcccggaggacagagatgcttcaggcagcccatcaggcagcggaggccaagaaggtgaagcccacccctccaccgaacgattgggctgtgacacaggtccaatgctgcgtgaattggagatcaggtggcgtgttggccaatcacctctctggaggcttgaaccaccagatcgagcatcatctgttccccagcatctcgcatgccaactaccccatcatcgcccgtgttgtgaaggaggtgtgcgaggagtatgggttgccgtacaagaactacgtcacgttctgggatgcagtctgtggcatggttcagcacctccggttgatgggtgctccaccggtgccaacgaacggggacaaaaagtcataagcggccgcacctgaattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaa

SEQ ID NO: 49 - DNA, 9373 bp, Artificial Sequence
  plasmid pY141
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggcggatagcccagtcatcaacctcagcaccatgtggaaacccctttcactgatggctttggaccttgccgttttgggacatgtctggaagcaggcacaacaggagggcagcatttcggcctatgctgattctgtttggactcctctcattatgtccggtttatacttatcaatgatcttcgtggggtgccgctggatgaagaaccgtgaaccctttgagatcaaaacatacatgtttgcgtataacctgtatcagaccttgatgaacctttgcatcgtgttgggattcttgtaccaggtgcatgccactgggatgcgcttttggggaagtggtgtcgaccgaagcccaaaaggtttgggcattggcttcttcatttatgcccactaccacaacaagtatgtggaatattttgatacactttttatggtgctgcgaaagaagaacaaccagatttctttccttcacgtgtatcatcatgccctgttgacatgggcttggtttgctgttgtgtatttcgcacctggaggtgatggctggtttggagcttgctacaattcttccatccatgtcctgatgtactcttactacttgcttgcaacttttggcatcagttgcccttggaagaagatcttgacacagctccagatggttcaattctgtttctgttttacacattccatttatgtgtggatttgcgggtcagagatctacccacggcctctgactgctttgcagtcgttcgtgatggtcaatatgttggtgctgtttggcaatttctatgtcaagcaatactcccaaaagaacggcaagccggagaacggagccacccctgagaacggagcgaagccgcaaccttgcgagaacggcacggtggaaaagcgagagaatgacaccgccaacgttcggcccgcccgtccagctggactcccgccggccacgtactacgactccctggcagtgtcggggcagggcaaggagcggctgttcaccaccgatgaggtgaggcggcacatcctccccaccgatggctggctgacgtgccacgaaggagtctacgatgtcactgatttccttgccaagcaccctggtggcggtgtcatcacgctgggccttggaagggactgcacaatcctcgtcgagtcataccaccctgctgggcgcccggacaaggtgatggagaagtaccgcattggtacgctgcaggaccccaagacgttctatgcttggggagagtccgatttctaccctgagttgaagcgccgggcccttgcaaggctgaaggaggctggtcaggcgcggcgcggcggccttggggtgaaggccctcctggtgctcaccctcttcttcgtgtcgtggtacatgtgggtggcccacaagtccttcctctgggccgccgtctggggcttcgccggctcccacgtcgggctgagcatccagcacgacggcaaccacggcgcgttcagccgcagcacactggtgaaccgcctggcggggtggggcatggacttgatcggcgcgtcgtcaacggtgtgggagtaccagcacgtcatcggccaccaccagtacaccaacctcgtgtcggacacgctattcagtctgcctgagaacgatccggacgtcttctccagctacccgctgatgcgcatgcacccggatacggcgtggcagccgcaccaccgcttccagcacctgttcgcgttcccactgttcgccctgatgacaatcagcaaggtgctgaccagcgatttcgctgtctgcctcagcatgaagaaggggtccatcgactgctcctccaggctcgtcccactggaggggcagctgctgttctggggggccaagctggcgaacttcctgttgcagattgtgttgccatgctacctccacgggacagctatgggcctggccctcttctctgttgcccaccttgtgtcgggggagtacctcgcgatctgcttcatcatcaaccacatcagcgagtcttgtgagtttatgaatacaagctttcaaaccgccgcccggaggacagagatgcttcaggcagcccatcaggcagcggaggccaagaaggtgaagcccacccctccaccgaacgattgggctgtgacacaggtccaatgctgcgtgaattggagatcaggtggcgtgttggccaatcacctctctggaggcttgaaccaccagatcgagcatcatctgttccccagcatctcgcatgccaactaccccatcatcgcccgtgttgtgaaggaggtgtgcgaggagtatgggttgccgtacaagaactacgtcacgttctgggatgcagtctgtggcatggttcagcacctccggttgatgggtgctccaccggtgccaacgaacggggacaaaaagtcataagc

SEQ ID NO: 50 - DNA, 35 bp, Artificial Sequence
  primer EgDPAEloDom-3
gcggccgctcaccgaacgttggcggtgtcattctc

SEQ ID NO: 51 - DNA, 4443 bp, Artificial Sequence
  plasmid pHD16
cctgaattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgccagtgtgatggatatctgcagaattcagggcggccgcaccatggcggatagcccagtcatcaacctcagcaccatgtggaaacccctttcactgatggctttggaccttgccgttttgggacatgtctggaagcaggcacaacaggagggcagcatttcggcctatgctgattctgtttggactcctctcattatgtccggtttatacttatcaatgatcttcgtggggtgccgctggatgaagaaccgtgaaccctttgagatcaaaacatacatgtttgcgtataacctgtatcagaccttgatgaacctttgcatcgtgttgggattcttgtaccaggtgcatgccactgggatgcgcttttggggaagtggtgtcgaccgaagcccaaaaggtttgggcattggcttcttcatttatgcccactaccacaacaagtatgtggaatattttgatacactttttatggtgctgcgaaagaagaacaaccagatttctttccttcacgtgtatcatcatgccctgttgacatgggcttggtttgctgttgtgtatttcgcacctggaggtgatggctggtttggagcttgctacaattcttccatccatgtcctgatgtactcttactacttgcttgcaacttttggcatcagttgcccttggaagaagatcttgacacagctccagatggttcaattctgtttctgttttacacattccatttatgtgtggatttgcgggtcagagatctacccacggcctctgactgctttgcagtcgttcgtgatggtcaatatgttggtgctgtttggcaatttctatgtcaagcaatactcccaaaagaacggcaagccggagaacggagccacccctgagaacggagcgaagccgcaaccttgcgagaacggcacggtggaaaagcgagagaatgacaccgccaacgttcggtgagcggccgc

SEQ ID NO: 52 - DNA, 7903 bp, Artificial Sequence
  plasmid pY143
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggcggatagcccagtcatcaacctcagcaccatgtggaaacccctttcactgatggctttggaccttgccgttttgggacatgtctggaagcaggcacaacaggagggcagcatttcggcctatgctgattctgtttggactcctctcattatgtccggtttatacttatcaatgatcttcgtggggtgccgctggatgaagaaccgtgaaccctttgagatcaaaacatacatgtttgcgtataacctgtatcagaccttgatgaacctttgcatcgtgttgggattcttgtaccaggtgcatgccactgggatgcgcttttggggaagtggtgtcgaccgaagcccaaaaggtttgggcattggcttcttcatttatgcccactaccacaacaagtatgtggaatattttgatacactttttatggtgctgcgaaagaagaacaaccagatttctttccttcacgtgtatcatcatgccctgttgacatgggcttggtttgctgttgtgtatttcgcacctggaggtgatggctggtttggagcttgctacaattcttccatccatgtcctgatgtactcttactacttgcttgcaacttttggcatcagttgcccttggaagaagatcttgacacagctccagatggttcaattctgtttctgttttacacattccatttatgtgtggatttgcgggtcagagatctacccacggcctctgactgctttgcagtcgttcgtgatggtcaatatgttggtgctgtttggcaatttctatgtcaagcaatactcccaaaagaacggcaagccggagaacggagccacccctgagaacggagcgaagccgcaaccttgcgagaacggcacggtggaaaagcgagagaatgacaccgccaacgttcggtgagc

SEQ ID NO: 53 - DNA, 26 bp, Artificial Sequence
  primer oEUGsyn6-2
tcctgcaggacactgccagggagtcg

SEQ ID NO: 54 - DNA, 4497 bp, Artificial Sequence
  plasmid pKR1071
aattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaagcccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgtatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgccagtgtgatggatatctgcagaattcagggcggccgcaccatggcggatagcccagtcatcaacctcagcaccatgtggaaacccctttcactgatggctttggaccttgccgttttgggacatgtctggaagcaggcacaacaggagggcagcatttcggcctatgctgattctgtttggactcctctcattatgtccggtttatacttatcaatgatcttcgtggggtgccgctggatgaagaaccgtgaaccctttgagatcaaaacatacatgtttgcgtataacctgtatcagaccttgatgaacctttgcatcgtgttgggattcttgtaccaggtgcatgccactgggatgcgcttttggggaagtggtgtcgaccgaagcccaaaaggtttgggcattggcttcttcatttatgcccactaccacaacaagtatgtggaatattttgatacactttttatggtgctgcgaaagaagaacaaccagatttctttccttcacgtgtatcatcatgccctgttgacatgggcttggtttgctgttgtgtatttcgcacctggaggtgatggctggtttggagcttgctacaattcttccatccatgtcctgatgtactcttactacttgcttgcaacttttggcatcagttgcccttggaagaagatcttgacacagctccagatggttcaattctgtttctgttttacacattccatttatgtgtggatttgcgggtcagagatctacccacggcctctgactgctttgcagtcgttcgtgatggtcaatatgttggtgctgtttggcaatttctatgtcaagcaatactcccaaaagaacggcaagccggagaacggagccacccctgagaacggagcgaagccgcaaccttgcgagaacggcacggtggaaaagcgagagaatgacaccgccaacgttcggcccgcccgtccagctggactcccgccggccacgtactacgactccctggcagtgtcctgcaggacctg

SEQ ID NO: 55 - DNA, 8005 bp, Artificial Sequence
  plasmid pY149
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggcggatagcccagtcatcaacctcagcaccatgtggaaacccctttcactgatggctttggaccttgccgttttgggacatgtctggaagcaggcacaacaggagggcagcatttcggcctatgctgattctgtttggactcctctcattatgtccggtttatacttatcaatgatcttcgtggggtgccgctggatgaagaaccgtgaaccctttgagatcaaaacatacatgtttgcgtataacctgtatcagaccttgatgaacctttgcatcgtgttgggattcttgtaccaggtgcatgccactgggatgcgcttttggggaagtggtgtcgaccgaagcccaaaaggtttgggcattggcttcttcatttatgcccactaccacaacaagtatgtggaatattttgatacactttttatggtgctgcgaaagaagaacaaccagatttctttccttcacgtgtatcatcatgccctgttgacatgggcttggtttgctgttgtgtatttcgcacctggaggtgatggctggtttggagcttgctacaattcttccatccatgtcctgatgtactcttactacttgcttgcaacttttggcatcagttgcccttggaagaagatcttgacacagctccagatggttcaattctgtttctgttttacacattccatttatgtgtggatttgcgggtcagagatctacccacggcctctgactgctttgcagtcgttcgtgatggtcaatatgttggtgctgtttggcaatttctatgtcaagcaatactcccaaaagaacggcaagccggagaacggagccacccctgagaacggagcgaagccgcaaccttgcgagaacggcacggtggaaaagcgagagaatgacaccgccaacgttcggcccgcccgtccagctggactcccgccggccacgtactacgactccctggcagtgtcctgcaggacctgaattccagcacactggcggccgttactagtggatccgag

SEQ ID NO: 56 - DNA, 27 bp, Artificial Sequence
  primer oEUGsyn6-3
tcctgcagggacactgccagggagtcg

SEQ ID NO: 57 - DNA, 4498 bp, Artificial Sequence
  plasmid pKR1091
ctagatgcatgctcgagcggccgccagtgtgatggatatctgcagaattcagggcggccgcaccatggcggatagcccagtcatcaacctcagcaccatgtggaaacccctttcactgatggctttggaccttgccgttttgggacatgtctggaagcaggcacaacaggagggcagcatttcggcctatgctgattctgtttggactcctctcattatgtccggtttatacttatcaatgatcttcgtggggtgccgctggatgaagaaccgtgaaccctttgagatcaaaacatacatgtttgcgtataacctgtatcagaccttgatgaacctttgcatcgtgttgggattcttgtaccaggtgcatgccactgggatgcgcttttggggaagtggtgtcgaccgaagcccaaaaggtttgggcattggcttcttcatttatgcccactaccacaacaagtatgtggaatattttgatacactttttatggtgctgcgaaagaagaacaaccagatttctttccttcacgtgtatcatcatgccctgttgacatgggcttggtttgctgttgtgtatttcgcacctggaggtgatggctggtttggagcttgctacaattcttccatccatgtcctgatgtactcttactacttgcttgcaacttttggcatcagttgcccttggaagaagatcttgacacagctccagatggttcaattctgtttctgttttacacattccatttatgtgtggatttgcgggtcagagatctacccacggcctctgactgctttgcagtcgttcgtgatggtcaatatgttggtgctgtttggcaatttctatgtcaagcaatactcccaaaagaacggcaagccggagaacggagccacccctgagaacggagcgaagccgcaaccttgcgagaacggcacggtggaaaagcgagagaatgacaccgccaacgttcggcccgcccgtccagctggactcccgccggccacgtactacgactccctggcagtgtccctgcaggacctgaattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaagcccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgtatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccct

SEQ ID NO: 58 - DNA, 8006 bp, Artificial Sequence
  plasmid pY155
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggcggatagcccagtcatcaacctcagcaccatgtggaaacccctttcactgatggctttggaccttgccgttttgggacatgtctggaagcaggcacaacaggagggcagcatttcggcctatgctgattctgtttggactcctctcattatgtccggtttatacttatcaatgatcttcgtggggtgccgctggatgaagaaccgtgaaccctttgagatcaaaacatacatgtttgcgtataacctgtatcagaccttgatgaacctttgcatcgtgttgggattcttgtaccaggtgcatgccactgggatgcgcttttggggaagtggtgtcgaccgaagcccaaaaggtttgggcattggcttcttcatttatgcccactaccacaacaagtatgtggaatattttgatacactttttatggtgctgcgaaagaagaacaaccagatttctttccttcacgtgtatcatcatgccctgttgacatgggcttggtttgctgttgtgtatttcgcacctggaggtgatggctggtttggagcttgctacaattcttccatccatgtcctgatgtactcttactacttgcttgcaacttttggcatcagttgcccttggaagaagatcttgacacagctccagatggttcaattctgtttctgttttacacattccatttatgtgtggatttgcgggtcagagatctacccacggcctctgactgctttgcagtcgttcgtgatggtcaatatgttggtgctgtttggcaatttctatgtcaagcaatactcccaaaagaacggcaagccggagaacggagccacccctgagaacggagcgaagccgcaaccttgcgagaacggcacggtggaaaagcgagagaatgacaccgccaacgttcggcccgcccgtccagctggactcccgccggccacgtactacgactccctggcagtgtccctgcaggacctgaattccagcacactggcggccgttactagtggatccgag

SEQ ID NO: 59 - DNA, 30 bp, Artificial Sequence
  oligonucleotide oRIG6-1
accatggccctgcaggcgcaggtcgagacg

SEQ ID NO: 60 - DNA, 28 bp, Artificial Sequence
  oligonucleotide oRIG6-2
tgcggccgcttagtccgccttgagcgtg

SEQ ID NO: 61 - DNA, 4827 bp, Artificial Sequence
  plasmid pKR1067
aattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaagcccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgtatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgccagtgtgatggatatctgcagaattcaggaccatggccctgcaggcgcaggtcgagacgcaggccttgcgcgccaaggaggcggcaaaaccgacgtggacgaagattcatgggcgcacagtcgacgtggagacgttccgccacccaggcggcaacatcctcgatttgttcctgggcatggatgccacaactgcctttgagacgttccacggtcaccacaagggagcatggaagatgctcaagacgctgcccgagaaggaggtcgccgccgccgacattcccgcgcagaaggaggagcacgtggccgagatgacacgcctcatggcctcatggcgcgagcgcgggctgttcaagccgcgtcccgtcgcctcatccatctatggcctgtgcgtgatcttcgccatcacggcatcggtcgcgtgcgctccgtacgcgccagtgctggctggcatcgcggtgggcacctgctgggctcagtgcggcttcttgcagcacatgggcggccaccgggagtgggggcgcacttggtcgtttgcgtttcagcatctgtttgaaggcctgctcaagggcggctcggcctcgtggtggcgcaaccgccacaacaagcaccatgccaagaccaacgtgctcggcgaggacggcgacctgcgcaccacacccttcttcgcatgggaccctactctggccaagaaagtgcccgactggtctctgcgcacgcaagccttcacctttctgccagcactgggagcttacgtcttcgtctttgccttcacggtacgcaagtacagtgtggtgaagcgtctctggcacgaggtcgccctgatggtggcccactacgctctcttttcctgggcgctcagcgccgccggcgcctccctcagctccggcctcaccttctattgcaccgggtacgcctggcagggcatctacctcggcttcttcttcggcctatcgcactttgcggtggagcgcgtgccgtcgaccgccacctggctcgagtcgacgatgatgggcaccgttgactggggcggctcctccgccttctgcggctacctctccggcttcctcaatatccagatcgagcaccacacggctccacaaatgccaatggagaacctgcgccagatccgggccgactgcaaggccgcggcccacaagttcgggctgccgtaccgcgagctgacattcgtcgcggcgaccaagctcatgatgagcggcctctaccggaccggcaaggacgagctcaagctgcgcgcggaccgccgcaagttcacgagggcacaggcgtacatgggcgccgccagcgctttggtcgacacgctcaaggcggactaagcggccgcacctg

SEQ ID NO: 62 - DNA, 8293 bp, Artificial Sequence
  plasmid pY150
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggccctgcaggcgcaggtcgagacgcaggccttgcgcgccaaggaggcggcaaaaccgacgtggacgaagattcatgggcgcacagtcgacgtggagacgttccgccacccaggcggcaacatcctcgatttgttcctgggcatggatgccacaactgcctttgagacgttccacggtcaccacaagggagcatggaagatgctcaagacgctgcccgagaaggaggtcgccgccgccgacattcccgcgcagaaggaggagcacgtggccgagatgacacgcctcatggcctcatggcgcgagcgcgggctgttcaagccgcgtcccgtcgcctcatccatctatggcctgtgcgtgatcttcgccatcacggcatcggtcgcgtgcgctccgtacgcgccagtgctggctggcatcgcggtgggcacctgctgggctcagtgcggcttcttgcagcacatgggcggccaccgggagtgggggcgcacttggtcgtttgcgtttcagcatctgtttgaaggcctgctcaagggcggctcggcctcgtggtggcgcaaccgccacaacaagcaccatgccaagaccaacgtgctcggcgaggacggcgacctgcgcaccacacccttcttcgcatgggaccctactctggccaagaaagtgcccgactggtctctgcgcacgcaagccttcacctttctgccagcactgggagcttacgtcttcgtctttgccttcacggtacgcaagtacagtgtggtgaagcgtctctggcacgaggtcgccctgatggtggcccactacgctctcttttcctgggcgctcagcgccgccggcgcctccctcagctccggcctcaccttctattgcaccgggtacgcctggcagggcatctacctcggcttcttcttcggcctatcgcactttgcggtggagcgcgtgccgtcgaccgccacctggctcgagtcgacgatgatgggcaccgttgactggggcggctcctccgccttctgcggctacctctccggcttcctcaatatccagatcgagcaccacacggctccacaaatgccaatggagaacctgcgccagatccgggccgactgcaaggccgcggcccacaagttcgggctgccgtaccgcgagctgacattcgtcgcggcgaccaagctcatgatgagcggcctctaccggaccggcaaggacgagctcaagctgcgcgcggaccgccgcaagttcacgagggcacaggcgtacatgggcgccgccagcgctttggtcgacacgctcaaggcggactaagc

SEQ ID NO: 63 - DNA, 5795 bp, Artificial Sequence
  plasmid pKR1097
ctagatgcatgctcgagcggccgccagtgtgatggatatctgcagaattcagggcggccgcaccatggcggatagcccagtcatcaacctcagcaccatgtggaaacccctttcactgatggctttggaccttgccgttttgggacatgtctggaagcaggcacaacaggagggcagcatttcggcctatgctgattctgtttggactcctctcattatgtccggtttatacttatcaatgatcttcgtggggtgccgctggatgaagaaccgtgaaccctttgagatcaaaacatacatgtttgcgtataacctgtatcagaccttgatgaacctttgcatcgtgttgggattcttgtaccaggtgcatgccactgggatgcgcttttggggaagtggtgtcgaccgaagcccaaaaggtttgggcattggcttcttcatttatgcccactaccacaacaagtatgtggaatattttgatacactttttatggtgctgcgaaagaagaacaaccagatttctttccttcacgtgtatcatcatgccctgttgacatgggcttggtttgctgttgtgtatttcgcacctggaggtgatggctggtttggagcttgctacaattcttccatccatgtcctgatgtactcttactacttgcttgcaacttttggcatcagttgcccttggaagaagatcttgacacagctccagatggttcaattctgtttctgttttacacattccatttatgtgtggatttgcgggtcagagatctacccacggcctctgactgctttgcagtcgttcgtgatggtcaatatgttggtgctgtttggcaatttctatgtcaagcaatactcccaaaagaacggcaagccggagaacggagccacccctgagaacggagcgaagccgcaaccttgcgagaacggcacggtggaaaagcgagagaatgacaccgccaacgttcggcccgcccgtccagctggactcccgccggccacgtactacgactccctggcagtgtccctgcaggcgcaggtcgagacgcaggccttgcgcgccaaggaggcggcaaaaccgacgtggacgaagattcatgggcgcacagtcgacgtggagacgttccgccacccaggcggcaacatcctcgatttgttcctgggcatggatgccacaactgcctttgagacgttccacggtcaccacaagggagcatggaagatgctcaagacgctgcccgagaaggaggtcgccgccgccgacattcccgcgcagaaggaggagcacgtggccgagatgacacgcctcatggcctcatggcgcgagcgcgggctgttcaagccgcgtcccgtcgcctcatccatctatggcctgtgcgtgatcttcgccatcacggcatcggtcgcgtgcgctccgtacgcgccagtgctggctggcatcgcggtgggcacctgctgggctcagtgcggcttcttgcagcacatgggcggccaccgggagtgggggcgcacttggtcgtttgcgtttcagcatctgtttgaaggcctgctcaagggcggctcggcctcgtggtggcgcaaccgccacaacaagcaccatgccaagaccaacgtgctcggcgaggacggcgacctgcgcaccacacccttcttcgcatgggaccctactctggccaagaaagtgcccgactggtctctgcgcacgcaagccttcacctttctgccagcactgggagcttacgtcttcgtctttgccttcacggtacgcaagtacagtgtggtgaagcgtctctggcacgaggtcgccctgatggtggcccactacgctctcttttcctgggcgctcagcgccgccggcgcctccctcagctccggcctcaccttctattgcaccgggtacgcctggcagggcatctacctcggcttcttcttcggcctatcgcactttgcggtggagcgcgtgccgtcgaccgccacctggctcgagtcgacgatgatgggcaccgttgactggggcggctcctccgccttctgcggctacctctccggcttcctcaatatccagatcgagcaccacacggctccacaaatgccaatggagaacctgcgccagatccgggccgactgcaaggccgcggcccacaagttcgggctgccgtaccgcgagctgacattcgtcgcggcgaccaagctcatgatgagcggcctctaccggaccggcaaggacgagctcaagctgcgcgcggaccgccgcaagttcacgagggcacaggcgtacatgggcgccgccagcgctttggtcgacacgctcaaggcggactaagcggccgcacctgaattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaagcccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgtatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccct

SEQ ID NO: 64 - DNA, 9253 bp, Artificial Sequence
  plasmid pY156
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggcggatagcccagtcatcaacctcagcaccatgtggaaacccctttcactgatggctttggaccttgccgttttgggacatgtctggaagcaggcacaacaggagggcagcatttcggcctatgctgattctgtttggactcctctcattatgtccggtttatacttatcaatgatcttcgtggggtgccgctggatgaagaaccgtgaaccctttgagatcaaaacatacatgtttgcgtataacctgtatcagaccttgatgaacctttgcatcgtgttgggattcttgtaccaggtgcatgccactgggatgcgcttttggggaagtggtgtcgaccgaagcccaaaaggtttgggcattggcttcttcatttatgcccactaccacaacaagtatgtggaatattttgatacactttttatggtgctgcgaaagaagaacaaccagatttctttccttcacgtgtatcatcatgccctgttgacatgggcttggtttgctgttgtgtatttcgcacctggaggtgatggctggtttggagcttgctacaattcttccatccatgtcctgatgtactcttactacttgcttgcaacttttggcatcagttgcccttggaagaagatcttgacacagctccagatggttcaattctgtttctgttttacacattccatttatgtgtggatttgcgggtcagagatctacccacggcctctgactgctttgcagtcgttcgtgatggtcaatatgttggtgctgtttggcaatttctatgtcaagcaatactcccaaaagaacggcaagccggagaacggagccacccctgagaacggagcgaagccgcaaccttgcgagaacggcacggtggaaaagcgagagaatgacaccgccaacgttcggcccgcccgtccagctggactcccgccggccacgtactacgactccctggcagtgtccctgcaggcgcaggtcgagacgcaggccttgcgcgccaaggaggcggcaaaaccgacgtggacgaagattcatgggcgcacagtcgacgtggagacgttccgccacccaggcggcaacatcctcgatttgttcctgggcatggatgccacaactgcctttgagacgttccacggtcaccacaagggagcatggaagatgctcaagacgctgcccgagaaggaggtcgccgccgccgacattcccgcgcagaaggaggagcacgtggccgagatgacacgcctcatggcctcatggcgcgagcgcgggctgttcaagccgcgtcccgtcgcctcatccatctatggcctgtgcgtgatcttcgccatcacggcatcggtcgcgtgcgctccgtacgcgccagtgctggctggcatcgcggtgggcacctgctgggctcagtgcggcttcttgcagcacatgggcggccaccgggagtgggggcgcacttggtcgtttgcgtttcagcatctgtttgaaggcctgctcaagggcggctcggcctcgtggtggcgcaaccgccacaacaagcaccatgccaagaccaacgtgctcggcgaggacggcgacctgcgcaccacacccttcttcgcatgggaccctactctggccaagaaagtgcccgactggtctctgcgcacgcaagccttcacctttctgccagcactgggagcttacgtcttcgtctttgccttcacggtacgcaagtacagtgtggtgaagcgtctctggcacgaggtcgccctgatggtggcccactacgctctcttttcctgggcgctcagcgccgccggcgcctccctcagctccggcctcaccttctattgcaccgggtacgcctggcagggcatctacctcggcttcttcttcggcctatcgcactttgcggtggagcgcgtgccgtcgaccgccacctggctcgagtcgacgatgatgggcaccgttgactggggcggctcctccgccttctgcggctacctctccggcttcctcaatatccagatcgagcaccacacggctccacaaatgccaatggagaacctgcgccagatccgggccgactgcaaggccgcggcccacaagttcgggctgccgtaccgcgagctgacattcgtcgcggcgaccaagctcatgatgagcggcctctaccggaccggcaaggacgagctcaagctgcgcgcggaccgccgcaagttcacgagggcacaggcgtacatgggcgccgccagcgctttggtcgacacgctcaaggcggactaagc

SEQ ID NO: 65 - DNA, 30 bp, Artificial Sequence
  oligonucleotides oEGslne6-1
accatggccctgcagggcaaggagcggctg

SEQ ID NO: 66 - DNA, 4947 bp, Artificial Sequence
  plasmid pKR1069
aattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaagcccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgtatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgccagtgtgatggatatctgcagaattcaggaccatggccctgcagggcaaggagcggctgttcaccaccgatgaggtgaggcggcacatcctccccaccgatggctggctgacgtgccacgaaggagtctacgatgtcactgatttccttgccaagcaccctggtggcggtgtcatcacgctgggccttggaagggactgcacaatcctcgtcgagtcataccaccctgctgggcgcccggacaaggtgatggagaagtaccgcattggtacgctgcaggaccccaagacgttctatgcttggggagagtccgatttctaccctgagttgaagcgccgggcccttgcaaggctgaaggaggctggtcaggcgcggcgcggcggccttggggtgaaggccctcctggtgctcaccctcttcttcgtgtcgtggtacatgtgggtggcccacaagtccttcctctgggccgccgtctggggcttcgccggctcccacgtcgggctgagcatccagcacgacggcaaccacggcgcgttcagccgcagcacactggtgaaccgcctggcggggtggggcatggacttgatcggcgcgtcgtcaacggtgtgggagtaccagcacgtcatcggccaccaccagtacaccaacctcgtgtcggacacgctattcagtctgcctgagaacgatccggacgtcttctccagctacccgctgatgcgcatgcacccggatacggcgtggcagccgcaccaccgcttccagcacctgttcgcgttcccactgttcgccctgatgacaatcagcaaggtgctgaccagcgatttcgctgtctgcctcagcatgaagaaggggtccatcgactgctcctccaggctcgtcccactggaggggcagctgctgttctggggggccaagctggcgaacttcctgttgcagattgtgttgccatgctacctccacgggacagctatgggcctggccctcttctctgttgcccaccttgtgtcgggggagtacctcgcgatctgcttcatcatcaaccacatcagcgagtcttgtgagtttatgaatacaagctttcaaaccgccgcccggaggacagagatgcttcaggcagcccatcaggcagcggaggccaagaaggtgaagcccacccctccaccgaacgattgggctgtgacacaggtccaatgctgcgtgaattggagatcaggtggcgtgttggccaatcacctctctggaggcttgaaccaccagatcgagcatcatctgttccccagcatctcgcatgccaactaccccatcatcgcccgtgttgtgaaggaggtgtgcgaggagtatgggttgccgtacaagaactacgtcacgttctgggatgcagtctgtggcatggttcagcacctccggttgatgggtgctccaccggtgccaacgaacggggacaaaaagtcataagcggccgcacctg

SEQ ID NO: 67 - DNA, 8413 bp, Artificial Sequence
  plasmid pY152
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggccctgcagggcaaggagcggctgttcaccaccgatgaggtgaggcggcacatcctccccaccgatggctggctgacgtgccacgaaggagtctacgatgtcactgatttccttgccaagcaccctggtggcggtgtcatcacgctgggccttggaagggactgcacaatcctcgtcgagtcataccaccctgctgggcgcccggacaaggtgatggagaagtaccgcattggtacgctgcaggaccccaagacgttctatgcttggggagagtccgatttctaccctgagttgaagcgccgggcccttgcaaggctgaaggaggctggtcaggcgcggcgcggcggccttggggtgaaggccctcctggtgctcaccctcttcttcgtgtcgtggtacatgtgggtggcccacaagtccttcctctgggccgccgtctggggcttcgccggctcccacgtcgggctgagcatccagcacgacggcaaccacggcgcgttcagccgcagcacactggtgaaccgcctggcggggtggggcatggacttgatcggcgcgtcgtcaacggtgtgggagtaccagcacgtcatcggccaccaccagtacaccaacctcgtgtcggacacgctattcagtctgcctgagaacgatccggacgtcttctccagctacccgctgatgcgcatgcacccggatacggcgtggcagccgcaccaccgcttccagcacctgttcgcgttcccactgttcgccctgatgacaatcagcaaggtgctgaccagcgatttcgctgtctgcctcagcatgaagaaggggtccatcgactgctcctccaggctcgtcccactggaggggcagctgctgttctggggggccaagctggcgaacttcctgttgcagattgtgttgccatgctacctccacgggacagctatgggcctggccctcttctctgttgcccaccttgtgtcgggggagtacctcgcgatctgcttcatcatcaaccacatcagcgagtcttgtgagtttatgaatacaagctttcaaaccgccgcccggaggacagagatgcttcaggcagcccatcaggcagcggaggccaagaaggtgaagcccacccctccaccgaacgattgggctgtgacacaggtccaatgctgcgtgaattggagatcaggtggcgtgttggccaatcacctctctggaggcttgaaccaccagatcgagcatcatctgttccccagcatctcgcatgccaactaccccatcatcgcccgtgttgtgaaggaggtgtgcgaggagtatgggttgccgtacaagaactacgtcacgttctgggatgcagtctgtggcatggttcagcacctccggttgatgggtgctccaccggtgccaacgaacggggacaaaaagtcataagc

SEQ ID NO: 68 - DNA, 5915 bp, Artificial Sequence
  plasmid pKR1099
ctagatgcatgctcgagcggccgccagtgtgatggatatctgcagaattcagggcggccgcaccatggcggatagcccagtcatcaacctcagcaccatgtggaaacccctttcactgatggctttggaccttgccgttttgggacatgtctggaagcaggcacaacaggagggcagcatttcggcctatgctgattctgtttggactcctctcattatgtccggtttatacttatcaatgatcttcgtggggtgccgctggatgaagaaccgtgaaccctttgagatcaaaacatacatgtttgcgtataacctgtatcagaccttgatgaacctttgcatcgtgttgggattcttgtaccaggtgcatgccactgggatgcgcttttggggaagtggtgtcgaccgaagcccaaaaggtttgggcattggcttcttcatttatgcccactaccacaacaagtatgtggaatattttgatacactttttatggtgctgcgaaagaagaacaaccagatttctttccttcacgtgtatcatcatgccctgttgacatgggcttggtttgctgttgtgtatttcgcacctggaggtgatggctggtttggagcttgctacaattcttccatccatgtcctgatgtactcttactacttgcttgcaacttttggcatcagttgcccttggaagaagatcttgacacagctccagatggttcaattctgtttctgttttacacattccatttatgtgtggatttgcgggtcagagatctacccacggcctctgactgctttgcagtcgttcgtgatggtcaatatgttggtgctgtttggcaatttctatgtcaagcaatactcccaaaagaacggcaagccggagaacggagccacccctgagaacggagcgaagccgcaaccttgcgagaacggcacggtggaaaagcgagagaatgacaccgccaacgttcggcccgcccgtccagctggactcccgccggccacgtactacgactccctggcagtgtccctgcagggcaaggagcggctgttcaccaccgatgaggtgaggcggcacatcctccccaccgatggctggctgacgtgccacgaaggagtctacgatgtcactgatttccttgccaagcaccctggtggcggtgtcatcacgctgggccttggaagggactgcacaatcctcgtcgagtcataccaccctgctgggcgcccggacaaggtgatggagaagtaccgcattggtacgctgcaggaccccaagacgttctatgcttggggagagtccgatttctaccctgagttgaagcgccgggcccttgcaaggctgaaggaggctggtcaggcgcggcgcggcggccttggggtgaaggccctcctggtgctcaccctcttcttcgtgtcgtggtacatgtgggtggcccacaagtccttcctctgggccgccgtctggggcttcgccggctcccacgtcgggctgagcatccagcacgacggcaaccacggcgcgttcagccgcagcacactggtgaaccgcctggcggggtggggcatggacttgatcggcgcgtcgtcaacggtgtgggagtaccagcacgtcatcggccaccaccagtacaccaacctcgtgtcggacacgctattcagtctgcctgagaacgatccggacgtcttctccagctacccgctgatgcgcatgcacccggatacggcgtggcagccgcaccaccgcttccagcacctgttcgcgttcccactgttcgccctgatgacaatcagcaaggtgctgaccagcgatttcgctgtctgcctcagcatgaagaaggggtccatcgactgctcctccaggctcgtcccactggaggggcagctgctgttctggggggccaagctggcgaacttcctgttgcagattgtgttgccatgctacctccacgggacagctatgggcctggccctcttctctgttgcccaccttgtgtcgggggagtacctcgcgatctgcttcatcatcaaccacatcagcgagtcttgtgagtttatgaatacaagctttcaaaccgccgcccggaggacagagatgcttcaggcagcccatcaggcagcggaggccaagaaggtgaagcccacccctccaccgaacgattgggctgtgacacaggtccaatgctgcgtgaattggagatcaggtggcgtgttggccaatcacctctctggaggcttgaaccaccagatcgagcatcatctgttccccagcatctcgcatgccaactaccccatcatcgcccgtgttgtgaaggaggtgtgcgaggagtatgggttgccgtacaagaactacgtcacgttctgggatgcagtctgtggcatggttcagcacctccggttgatgggtgctccaccggtgccaacgaacggggacaaaaagtcataagcggccgcacctgaattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaagcccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgtatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccct

SEQ ID NO: 69 - DNA, 9373 bp, Artificial Sequence
  plasmid pY157
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggcggatagcccagtcatcaacctcagcaccatgtggaaacccctttcactgatggctttggaccttgccgttttgggacatgtctggaagcaggcacaacaggagggcagcatttcggcctatgctgattctgtttggactcctctcattatgtccggtttatacttatcaatgatcttcgtggggtgccgctggatgaagaaccgtgaaccctttgagatcaaaacatacatgtttgcgtataacctgtatcagaccttgatgaacctttgcatcgtgttgggattcttgtaccaggtgcatgccactgggatgcgcttttggggaagtggtgtcgaccgaagcccaaaaggtttgggcattggcttcttcatttatgcccactaccacaacaagtatgtggaatattttgatacactttttatggtgctgcgaaagaagaacaaccagatttctttccttcacgtgtatcatcatgccctgttgacatgggcttggtttgctgttgtgtatttcgcacctggaggtgatggctggtttggagcttgctacaattcttccatccatgtcctgatgtactcttactacttgcttgcaacttttggcatcagttgcccttggaagaagatcttgacacagctccagatggttcaattctgtttctgttttacacattccatttatgtgtggatttgcgggtcagagatctacccacggcctctgactgctttgcagtcgttcgtgatggtcaatatgttggtgctgtttggcaatttctatgtcaagcaatactcccaaaagaacggcaagccggagaacggagccacccctgagaacggagcgaagccgcaaccttgcgagaacggcacggtggaaaagcgagagaatgacaccgccaacgttcggcccgcccgtccagctggactcccgccggccacgtactacgactccctggcagtgtccctgcagggcaaggagcggctgttcaccaccgatgaggtgaggcggcacatcctccccaccgatggctggctgacgtgccacgaaggagtctacgatgtcactgatttccttgccaagcaccctggtggcggtgtcatcacgctgggccttggaagggactgcacaatcctcgtcgagtcataccaccctgctgggcgcccggacaaggtgatggagaagtaccgcattggtacgctgcaggaccccaagacgttctatgcttggggagagtccgatttctaccctgagttgaagcgccgggcccttgcaaggctgaaggaggctggtcaggcgcggcgcggcggccttggggtgaaggccctcctggtgctcaccctcttcttcgtgtcgtggtacatgtgggtggcccacaagtccttcctctgggccgccgtctggggcttcgccggctcccacgtcgggctgagcatccagcacgacggcaaccacggcgcgttcagccgcagcacactggtgaaccgcctggcggggtggggcatggacttgatcggcgcgtcgtcaacggtgtgggagtaccagcacgtcatcggccaccaccagtacaccaacctcgtgtcggacacgctattcagtctgcctgagaacgatccggacgtcttctccagctacccgctgatgcgcatgcacccggatacggcgtggcagccgcaccaccgcttccagcacctgttcgcgttcccactgttcgccctgatgacaatcagcaaggtgctgaccagcgatttcgctgtctgcctcagcatgaagaaggggtccatcgactgctcctccaggctcgtcccactggaggggcagctgctgttctggggggccaagctggcgaacttcctgttgcagattgtgttgccatgctacctccacgggacagctatgggcctggccctcttctctgttgcccaccttgtgtcgggggagtacctcgcgatctgcttcatcatcaaccacatcagcgagtcttgtgagtttatgaatacaagctttcaaaccgccgcccggaggacagagatgcttcaggcagcccatcaggcagcggaggccaagaaggtgaagcccacccctccaccgaacgattgggctgtgacacaggtccaatgctgcgtgaattggagatcaggtggcgtgttggccaatcacctctctggaggcttgaaccaccagatcgagcatcatctgttccccagcatctcgcatgccaactaccccatcatcgcccgtgttgtgaaggaggtgtgcgaggagtatgggttgccgtacaagaactacgtcacgttctgggatgcagtctgtggcatggttcagcacctccggttgatgggtgctccaccggtgccaacgaacggggacaaaaagtcataagc

SEQ ID NO: 70 - DNA, 20 bp, Artificial Sequence
  oligonucleotide oEUGel4-4
aacatgttggtgctgtttgg

SEQ ID NO: 71 - DNA, 5151 bp, Artificial Sequence
  plasmid pKR1073
aattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaagcccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgtatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgccagtgtgatggatatctgcagaattcaggaacatgttggtgctgtttggcaatttctatgtcaagcaatactcccaaaagaacggcaagccggagaacggagccacccctgagaacggagcgaagccgcaaccttgcgagaacggcacggtggaaaagcgagagaatgacaccgccaacgttcggcccgcccgtccagctggactcccgccggccacgtactacgactccctggcagtgtcggggcagggcaaggagcggctgttcaccaccgatgaggtgaggcggcacatcctccccaccgatggctggctgacgtgccacgaaggagtctacgatgtcactgatttccttgccaagcaccctggtggcggtgtcatcacgctgggccttggaagggactgcacaatcctcgtcgagtcataccaccctgctgggcgcccggacaaggtgatggagaagtaccgcattggtacgctgcaggaccccaagacgttctatgcttggggagagtccgatttctaccctgagttgaagcgccgggcccttgcaaggctgaaggaggctggtcaggcgcggcgcggcggccttggggtgaaggccctcctggtgctcaccctcttcttcgtgtcgtggtacatgtgggtggcccacaagtccttcctctgggccgccgtctggggcttcgccggctcccacgtcgggctgagcatccagcacgacggcaaccacggcgcgttcagccgcagcacactggtgaaccgcctggcggggtggggcatggacttgatcggcgcgtcgtcaacggtgtgggagtaccagcacgtcatcggccaccaccagtacaccaacctcgtgtcggacacgctattcagtctgcctgagaacgatccggacgtcttctccagctacccgctgatgcgcatgcacccggatacggcgtggcagccgcaccaccgcttccagcacctgttcgcgttcccactgttcgccctgatgacaatcagcaaggtgctgaccagcgatttcgctgtctgcctcagcatgaagaaggggtccatcgactgctcctccaggctcgtcccactggaggggcagctgctgttctggggggccaagctggcgaacttcctgttgcagattgtgttgccatgctacctccacgggacagctatgggcctggccctcttctctgttgcccaccttgtgtcgggggagtacctcgcgatctgcttcatcatcaaccacatcagcgagtcttgtgagtttatgaatacaagctttcaaaccgccgcccggaggacagagatgcttcaggcagcccatcaggcagcggaggccaagaaggtgaagcccacccctccaccgaacgattgggctgtgacacaggtccaatgctgcgtgaattggagatcaggtggcgtgttggccaatcacctctctggaggcttgaaccaccagatcgagcatcatctgttccccagcatctcgcatgccaactaccccatcatcgcccgtgttgtgaaggaggtgtgcgaggagtatgggttgccgtacaagaactacgtcacgttctgggatgcagtctgtggcatggttcagcacctccggttgatgggtgctccaccggtgccaacgaacggggacaaaaagtcataagcggccgcacctg

SEQ ID NO: 72 - DNA, 8617 bp, Artificial Sequence
  plasmid pY153
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatgttggtgctgtttggcaatttctatgtcaagcaatactcccaaaagaacggcaagccggagaacggagccacccctgagaacggagcgaagccgcaaccttgcgagaacggcacggtggaaaagcgagagaatgacaccgccaacgttcggcccgcccgtccagctggactcccgccggccacgtactacgactccctggcagtgtcggggcagggcaaggagcggctgttcaccaccgatgaggtgaggcggcacatcctccccaccgatggctggctgacgtgccacgaaggagtctacgatgtcactgatttccttgccaagcaccctggtggcggtgtcatcacgctgggccttggaagggactgcacaatcctcgtcgagtcataccaccctgctgggcgcccggacaaggtgatggagaagtaccgcattggtacgctgcaggaccccaagacgttctatgcttggggagagtccgatttctaccctgagttgaagcgccgggcccttgcaaggctgaaggaggctggtcaggcgcggcgcggcggccttggggtgaaggccctcctggtgctcaccctcttcttcgtgtcgtggtacatgtgggtggcccacaagtccttcctctgggccgccgtctggggcttcgccggctcccacgtcgggctgagcatccagcacgacggcaaccacggcgcgttcagccgcagcacactggtgaaccgcctggcggggtggggcatggacttgatcggcgcgtcgtcaacggtgtgggagtaccagcacgtcatcggccaccaccagtacaccaacctcgtgtcggacacgctattcagtctgcctgagaacgatccggacgtcttctccagctacccgctgatgcgcatgcacccggatacggcgtggcagccgcaccaccgcttccagcacctgttcgcgttcccactgttcgccctgatgacaatcagcaaggtgctgaccagcgatttcgctgtctgcctcagcatgaagaaggggtccatcgactgctcctccaggctcgtcccactggaggggcagctgctgttctggggggccaagctggcgaacttcctgttgcagattgtgttgccatgctacctccacgggacagctatgggcctggccctcttctctgttgcccaccttgtgtcgggggagtacctcgcgatctgcttcatcatcaaccacatcagcgagtcttgtgagtttatgaatacaagctttcaaaccgccgcccggaggacagagatgcttcaggcagcccatcaggcagcggaggccaagaaggtgaagcccacccctccaccgaacgattgggctgtgacacaggtccaatgctgcgtgaattggagatcaggtggcgtgttggccaatcacctctctggaggcttgaaccaccagatcgagcatcatctgttccccagcatctcgcatgccaactaccccatcatcgcccgtgttgtgaaggaggtgtgcgaggagtatgggttgccgtacaagaactacgtcacgttctgggatgcagtctgtggcatggttcagcacctccggttgatgggtgctccaccggtgccaacgaacggggacaaaaagtcataagc

SEQ ID NO: 73 - DNA, 30 bp, Artificial Sequence
  oligonucleotide oRSA1-1
accatggccctgcagggcggcgatgaggtg

SEQ ID NO: 74 - DNA, 28 bp, Artificial Sequence
  oligonucleotide oRSA1-2
tgcggccgctcacttggacttggggtgg

SEQ ID NO: 75 - DNA, 5058 bp, Artificial Sequence
  plasmid pKR1068
  misc_feature (5056)..(5056): n is a, c, g, or t
aattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaagcccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgtatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgccagtgtgatggatatctgcagaattcaggaccatggccctgcagggcggcgatgaggtgtacagcatggcgcaggtgcgcgaccacaacaccccggacgacgcctggtgcgccatccacggcgaggtgtacgagctgaccaagttcgcccgcacccaccccgggggggacatcatcttgctggccgccggcaaggaggccaccatcctgttcgagacgtaccacgtgcgccccatctccgacgcggtcctgcgcaagtaccgcatcggcaagctcgccgccgccggcaaggatgagccggccaacgacagcacctactacagctgggacagcgacttttacaaggtgctccgccagcgtgtcgtggcgcgtctcgaggagcgcaagatcgcccgccgcggcggccccgagatctggatcaaggccgccatcctcgtcagcggcttctggtccatgctctacctcatgtgcaccctggacccgaaccgcggcgccatcctggccgccatcgcgctgggcatcgtcgccgccttcgtcggcacgtgcattcagcacgacggcaaccacggcgcgttcgccttctctccgttcatgaacaagctctctggctggacgctcgacatgatcggcgccagtgccatgacctgggagatgcagcacgtgctgggccaccacccgtacaccaacctgatcgagatggagaacggcacccaaaaggtcacccacgccgacgtcgaccccaagaaggccgaccaggagagcgacccggacgtcttcagcacctaccccatgctccgtctgcacccgtggcaccgcaagcgcttctaccaccgcttccagcacctgtacgcgccgctgctcttcggtttcatgaccatcaacaaggtgatcacccaggatgtgggagttgtcctcagcaagcgtctgtttcagatcgatgccaactgccgttacgccagcaagtcgtacgttgcgcgcttctggatcatgaagctgctcaccgtcctctacatggtcgccctccccgtgtacacccagggccttgtcgacgggctcaagctcttcttcatcgcccacttttcgtgcggcgagctgctggccaccatgttcatcgtcaaccacatcatcgagggcgtctcgtacgcctccaaggactctgtcaagggcaccatggcgccgccgcgcacggtgcacggcgtgaccccgatgcatgacacccgcgacgcgctcggcaaggagaaggcagccaccaagcacgtgccgctcaacgactgggccgcggtccagtgccagacctcggtcaactggtcgatcggctcgtggttctggaaccacttctccggcgggctcaaccaccagatcgagcaccacctcttccccggcctcacccacaccacctacgtgtacattcaggatgtggtgcaggcgacgtgcgccgagtacggggtcccgtaccagtcggagcagagcctcttctccgcctacttcaagatgctctcccaccttcgggcgctcggcaacgagccgatgccctcgtgggagaaggaccaccccaagtccaagtgagcggccgcccntg

SEQ ID NO: 76 - DNA, 8524 bp, Artificial Sequence
  plasmid pY151
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggccctgcagggcggcgatgaggtgtacagcatggcgcaggtgcgcgaccacaacaccccggacgacgcctggtgcgccatccacggcgaggtgtacgagctgaccaagttcgcccgcacccaccccgggggggacatcatcttgctggccgccggcaaggaggccaccatcctgttcgagacgtaccacgtgcgccccatctccgacgcggtcctgcgcaagtaccgcatcggcaagctcgccgccgccggcaaggatgagccggccaacgacagcacctactacagctgggacagcgacttttacaaggtgctccgccagcgtgtcgtggcgcgtctcgaggagcgcaagatcgcccgccgcggcggccccgagatctggatcaaggccgccatcctcgtcagcggcttctggtccatgctctacctcatgtgcaccctggacccgaaccgcggcgccatcctggccgccatcgcgctgggcatcgtcgccgccttcgtcggcacgtgcattcagcacgacggcaaccacggcgcgttcgccttctctccgttcatgaacaagctctctggctggacgctcgacatgatcggcgccagtgccatgacctgggagatgcagcacgtgctgggccaccacccgtacaccaacctgatcgagatggagaacggcacccaaaaggtcacccacgccgacgtcgaccccaagaaggccgaccaggagagcgacccggacgtcttcagcacctaccccatgctccgtctgcacccgtggcaccgcaagcgcttctaccaccgcttccagcacctgtacgcgccgctgctcttcggtttcatgaccatcaacaaggtgatcacccaggatgtgggagttgtcctcagcaagcgtctgtttcagatcgatgccaactgccgttacgccagcaagtcgtacgttgcgcgcttctggatcatgaagctgctcaccgtcctctacatggtcgccctccccgtgtacacccagggccttgtcgacgggctcaagctcttcttcatcgcccacttttcgtgcggcgagctgctggccaccatgttcatcgtcaaccacatcatcgagggcgtctcgtacgcctccaaggactctgtcaagggcaccatggcgccgccgcgcacggtgcacggcgtgaccccgatgcatgacacccgcgacgcgctcggcaaggagaaggcagccaccaagcacgtgccgctcaacgactgggccgcggtccagtgccagacctcggtcaactggtcgatcggctcgtggttctggaaccacttctccggcgggctcaaccaccagatcgagcaccacctcttccccggcctcacccacaccacctacgtgtacattcaggatgtggtgcaggcgacgtgcgccgagtacggggtcccgtaccagtcggagcagagcctcttctccgcctacttcaagatgctctcccaccttcgggcgctcggcaacgagccgatgccctcgtgggagaaggaccaccccaagtccaagtgagc

SEQ ID NO: 77 - DNA, 9484 bp, Artificial Sequence
  plasmid pY160
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggcggatagcccagtcatcaacctcagcaccatgtggaaacccctttcactgatggctttggaccttgccgttttgggacatgtctggaagcaggcacaacaggagggcagcatttcggcctatgctgattctgtttggactcctctcattatgtccggtttatacttatcaatgatcttcgtggggtgccgctggatgaagaaccgtgaaccctttgagatcaaaacatacatgtttgcgtataacctgtatcagaccttgatgaacctttgcatcgtgttgggattcttgtaccaggtgcatgccactgggatgcgcttttggggaagtggtgtcgaccgaagcccaaaaggtttgggcattggcttcttcatttatgcccactaccacaacaagtatgtggaatattttgatacactttttatggtgctgcgaaagaagaacaaccagatttctttccttcacgtgtatcatcatgccctgttgacatgggcttggtttgctgttgtgtatttcgcacctggaggtgatggctggtttggagcttgctacaattcttccatccatgtcctgatgtactcttactacttgcttgcaacttttggcatcagttgcccttggaagaagatcttgacacagctccagatggttcaattctgtttctgttttacacattccatttatgtgtggatttgcgggtcagagatctacccacggcctctgactgctttgcagtcgttcgtgatggtcaatatgttggtgctgtttggcaatttctatgtcaagcaatactcccaaaagaacggcaagccggagaacggagccacccctgagaacggagcgaagccgcaaccttgcgagaacggcacggtggaaaagcgagagaatgacaccgccaacgttcggcccgcccgtccagctggactcccgccggccacgtactacgactccctggcagtgtccctgcagggcggcgatgaggtgtacagcatggcgcaggtgcgcgaccacaacaccccggacgacgcctggtgcgccatccacggcgaggtgtacgagctgaccaagttcgcccgcacccaccccgggggggacatcatcttgctggccgccggcaaggaggccaccatcctgttcgagacgtaccacgtgcgccccatctccgacgcggtcctgcgcaagtaccgcatcggcaagctcgccgccgccggcaaggatgagccggccaacgacagcacctactacagctgggacagcgacttttacaaggtgctccgccagcgtgtcgtggcgcgtctcgaggagcgcaagatcgcccgccgcggcggccccgagatctggatcaaggccgccatcctcgtcagcggcttctggtccatgctctacctcatgtgcaccctggacccgaaccgcggcgccatcctggccgccatcgcgctgggcatcgtcgccgccttcgtcggcacgtgcattcagcacgacggcaaccacggcgcgttcgccttctctccgttcatgaacaagctctctggctggacgctcgacatgatcggcgccagtgccatgacctgggagatgcagcacgtgctgggccaccacccgtacaccaacctgatcgagatggagaacggcacccaaaaggtcacccacgccgacgtcgaccccaagaaggccgaccaggagagcgacccggacgtcttcagcacctaccccatgctccgtctgcacccgtggcaccgcaagcgcttctaccaccgcttccagcacctgtacgcgccgctgctcttcggtttcatgaccatcaacaaggtgatcacccaggatgtgggagttgtcctcagcaagcgtctgtttcagatcgatgccaactgccgttacgccagcaagtcgtacgttgcgcgcttctggatcatgaagctgctcaccgtcctctacatggtcgccctccccgtgtacacccagggccttgtcgacgggctcaagctcttcttcatcgcccacttttcgtgcggcgagctgctggccaccatgttcatcgtcaaccacatcatcgagggcgtctcgtacgcctccaaggactctgtcaagggcaccatggcgccgccgcgcacggtgcacggcgtgaccccgatgcatgacacccgcgacgcgctcggcaaggagaaggcagccaccaagcacgtgccgctcaacgactgggccgcggtccagtgccagacctcggtcaactggtcgatcggctcgtggttctggaaccacttctccggcgggctcaaccaccagatcgagcaccacctcttccccggcctcacccacaccacctacgtgtacattcaggatgtggtgcaggcgacgtgcgccgagtacggggtcccgtaccagtcggagcagagcctcttctccgcctacttcaagatgctctcccaccttcgggcgctcggcaacgagccgatgccctcgtgggagaaggaccaccccaagtccaagtgagc

SEQ ID NO: 78 - DNA, 21 bp, Artificial Sequence
  oligonucleotide EaDHAsyn5'
gttgcagatggtgcaattctg

SEQ ID NO: 79 - DNA, 20 bp, Artificial Sequence
  oligonucleotide EaDHAsyn5'2
cagcctactacgatgccctg

SEQ ID NO: 80 - DNA, 20 bp, Artificial Sequence
  oligonucleotide EaDHAsyn5'3
gacgtcttcggcacctatcc

SEQ ID NO: 81 - DNA, 21 bp, Artificial Sequence
  oligonucleotide EaDHAsyn5'4
ggaatggtggagcacctcagg

SEQ ID NO: 82 - DNA, 20 bp, Artificial Sequence
  oligonucleotide EaDHAsyn3'
ctgaggtgctccaccattcc

SEQ ID NO: 83 - DNA, 22 bp, Artificial Sequence
  oligonucleotide EaDHAsyn3'2
gagatgtggttgatgatgaagc

SEQ ID NO: 84 - DNA, 20 bp, Artificial Sequence
  oligonucleotide EaDHAsyn3'3
gacgtgctggtactcccagg

SEQ ID NO: 85 - DNA, 20 bp, Artificial Sequence
  oligonucleotide EaDHAsyn3'4
ctcccgcatggtgaacttgc

SEQ ID NO: 86 - DNA, 22 bp, Artificial Sequence
  oligonucleotide EaDHAsyn3'5
gaacaacgtgtcgacatactcc

SEQ ID NO: 87 - DNA, 5582 bp, Artificial Sequence
  plasmid pLF117-1
  misc_feature (5530)..(5569): n is a, c, g, or t
gtacaaagttggcattataagaaagcattgcttatcaatttgttgcaacgaacaggtcactatcagtcaaaataaaatcattatttgccatccagctgatatcccctatagtgagtcgtattacatggtcatagctgtttcctggcagctctggcccgtgtctcaaaatctctgatgttacattgcacaagataaaaatatatcatcatgttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcatagatcttttctccatcactgatagggagtggtaaaataactccatcaatgatagagtgtcaacaacatgaccaaaatcccttaacgtgagttacgcgtattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggttacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagggaacgacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttaacgctagcatggatgttttcccagtcacgacgttgtaaaacgacggccagtcttaagctcgggccccaaataatgattttattttgactgatagtgacctgttcgttgcaacaaattgatgagcaatgcttttttataatgccaactttgtacaaaaaagttggattttttttcggtctccatggccgaaggcaagagcgatgggcctgtggtgacccttcaaagcatgtggaaaccgcttgctttgatggcagtagatgtcggcatattggtcaatgtccgccgcaaggctttcactgagtttgatgggcacagcaacgtttttgcagatccagtttacattccatttgtgatgaatctcttctacttgaccatgatctttgctgggtgccgttggatgaagactcgcgagccctttgagatcaagtcatatatgtttgcatacaatgcatatcagacaatgatgaacttcctcattgtcgtcgggttcatgtatgaggtgcacagcacagggatgcgatattgggggtccaggatcgacacctccaccaagggcttgggcctcggtttcctgatctatgcccactaccacaacaaatatgtggagtatgtcgacacgttgttcatgatcctgcgcaagaaaaacaaccagatctcgttcctccacgtctaccaccattcgcttttgacttgggcctggtgggccgtggtctactgggccccgggaggagatgcctggttcggagcatgctacaattccttcatccacgtgctgatgtactcctactacctgtttgcaacgtttggcatcaggtgcccctggaagaagatgctgacccagttgcagatggtgcaattctgcttctgctttgcccacgcgatgtatgttggatggctgggccatgaagtctacccgcgctggttgacggcgctgcaggcatttgtgatgctaaacatgctggtgctgttcggcaacttctacatgaagtcgtactccaaggccagcaagctggagccggcctcccccgtgtcccccgcctccctcgcccagaaaccgttcgagaacgccaaggtgaagcctgggggccccggcaagccaagcgagattgcgtcgctgccaccgccaattcgaccagtcgggaacccacctgcagcctactacgatgccctggcgacctcgggcaccgggcaggaccgcaagttcaccatgcgggaggtggcccgccatattgtgccgaccgacgggtggttggcatgccatgacggtgtctacgacatcaccgagttcatagggaaacatcctggcggcgatgttatttctctcggattgggcagggactccacaatcctggttgagtcgtaccaccctgccggaaggccagacaaggtcatggaaaagtaccgcatcgggacgctccaggaccaccgcacgttctacgactggcaggcctccgcgttctacgccgagctgaagcagcgggtggtgcagacgctaaaggaggccggccaaccgcggcgtgggggcctgtcggtcaaagcggcgctggtcatggcagcgttcgcggcgtcgttctacctcatggtgacccagggatccttcttctgggccgccgtctggggcctcgccggctcccacattggcctcagcatccagcacgacgggaaccacggggctttcagtaagagtggtcggctgaaccgcctcgcaggctggggcatggacgttatcggggcctcctcgacggcctgggagtaccagcacgtcatcgggcaccaccagtacaccaacctggtatcggatcccgagttcgcgctgcctgagaacgacccggacgtcttcggcacctatccgctgatgcggatgcatccggacaccccttggaagccgcaccaccagctgcagcatatgtacgcgttcccgctgttcgccctgatgaccatcagcaaggtcatcatcagtgacttcacgttctgcctcgccaagcggcgcgggccgatcgacttctccgccaggctcgtgccacttgaggggcagatgctcttctggggcgcgaagatcatggggttcctgatgcagatagtcctgccgtgctatctgcatggcatcgcccatgggctggcgctgttcatcacagcccacctggtgtcgggagagtacctcgcggtctgcttcatcatcaaccacatctctgagtcatgcgactatttgaatccaagttccgtcatcgctgcgcggcggacggaaatgctgaagcaggcggagcaggaggccaaggcaaagcagaagcaccccaccccaccgcccaacgactgggccgcgtctcaggtactgtgctgcgtaaactggcgctctggtggatatttctcaaaccacctctcaggcgggctgaaccaccagatcgagcaccacctcttccccagcatctcacatgcgaactatccgaccattgccccagttgtgaaaggggtgtgcgaggagtacggcctcccctacaagaactactcccagttctctgacgctatctatggaatggtggagcacctcagggcgatgggcacgaagcccgaagacaacggcaagctggcgccactgccgggctccctggaggacgtgtgcccggtcctgagtgccgccgttgctgcccaacctgacggaagcaccgacggcagcgctgcgggttgtccagcagtagccacactggcataaagggcataatgagcaatgccatcatcactagacgacgttgctcaccttgttttccatttgtgccgtgccttgcggcccgtgttctgcatttgcgggcactagattcggtacccagccctcctcacagctctgcgatttgagccgtttgaggcaacgctccgctgacccttgtgcaggtcccccgaccatccgctccgaggagggcggtaaaacaaaacaaataacaacagcatgaggcgtcaatctctgcgatatgcggggcttgctccagctcacctggaccacttcgtccgctgcgcagctatagttttggggccgcagctaggtctgcggttacttcctttttttttctccggcgcagggcgcttggttctaagcctttcctccaatcctcgagccccctcgacctgaccgtgtcttcctctggctgaaagcggaggatgatttgtgcgttgctcagaaggaacctccatcggtggtggttttcgcattcccattgannnnnnnnnnnnnnnnnnnnnnnnnnnnnnnnnnnnnnnnacccaactttctt

SEQ ID NO: 88 - DNA, 5607 bp, Artificial Sequence
  plasmid pLF117-2
gtacaaagttggcattataagaaagcattgcttatcaatttgttgcaacgaacaggtcactatcagtcaaaataaaatcattatttgccatccagctgatatcccctatagtgagtcgtattacatggtcatagctgtttcctggcagctctggcccgtgtctcaaaatctctgatgttacattgcacaagataaaaatatatcatcatgttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcatagatcttttctccatcactgatagggagtggtaaaataactccatcaatgatagagtgtcaacaacatgaccaaaatcccttaacgtgagttacgcgtattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggttacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagggaacgacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttaacgctagcatggatgttttcccagtcacgacgttgtaaaacgacggccagtcttaagctcgggccccaaataatgattttattttgactgatagtgacctgttcgttgcaacaaattgatgagcaatgcttttttataatgccaactttgtacaaaaaagttggattttttttcggtctccatggccgaaggcaagagcgatgggcctgtggtgacccttcaaagcatgtggaaaccgcttgctctgatggcaatagatgtcggcatattggtcaatgtccgccgcaaggctttcactgagtttgatgggcacagcaacgttttcgcagatccagtttacattccatttgtgatgaatctcttctacttgaccatgatctttgctgggtgccgttggatgaagactcgcgaaccctttgagatcaagtcatatatgtttgcatacaatgcatatcagacaatgatgaacttcctcattgtcgtcgggttcatgtatgaggtgcacagcacagggatgcgatattgggggtccaggatcgacacctccaccaagggcttgggcctcggtttcctgatctatgcccactaccacaacaaatacgtggagtatgtcgacacgttgttcatgatcctgcgcaagaaaaacaaccagatctcgttcctccacgtctaccaccattcgcttttgacttgggcctggtgggccgtggtctactgggccccaggaggagatgcctggttcggagcatgctacaattccttcatccacgtgctgatgtactcctactacctgtttgcaacgtttggcatcaggtgcccctggaagaagatgctgacccagttgcagatggtgcaattctgcttctgctttgcccacgcgatgtatgttggatggctgggccatgaagtctacccgcgctggttgacggcgctacaggcatttgtgatgctaaacatgctggtgctgttcggcaacttctacatgaagtcgtactccaaggccagcaagctggagccggcctcccccgtgtcccccgcctccctcgcccagaagccgttcgagaacgccaaggtgaagcctgggggccccggcaagccaagcgagattgcgtcgctgccaccgccaattcgaccagtcgggaacccacctgcagcctactacgatgccctggcgacctcgggcaccgggcaggaccgcaagttcaccatgcgggaggtggcccgccatattgtgccgaccgatgggtggttggcgtgccatgacggtgtctacgacatcaccgagttcatagggaaacatcctggcggcgatgttatttctctcggattgggcagggactccacaatcctggttgagtcgtaccaccctgccggaaggccagacaaggtcatggaaaagtaccgcatcgggacgctccaggaccaccgcacgttctacgactggcaggcctccgcgttctacgccgagctgaagcagcgggtggtgcagacgctaaaggaggccggccaaccgcggcgtgggggcctgtcggtcaaagcggcgctggtcatggcggcgttcgcagcgtcgttctacctcatggtgacccagggatccttcttctgggccgccgtctggggcctcgccggctcccacattggcctcagcatccagcacgacgggaaccacggggctttcagtaagagtggtcggctgaaccgcctcgcgggctggggcatggacgtcatcggggcctcctcgacggcctgggagtaccagcacgtcatcgggcaccaccagtacaccaacctggtatcggatcccgagttcgcgctgcctgagaacgacccggacgtcttcggcacctatccgctgatgcggatgcatccggacaccccttggaagccgcaccaccagctgcagcatgtgtacgcgttcccgctgttcgccctgatgaccatcagcaaggtcatcatcagcgacttcacgttctgcctcgccaagcggcgcgggccgatcgacttctccgccaggctcgtgccacttgaggggcagatgctcttctggggggcgaagatcatggggttcctgatgcagatagtcctgccgtgctatctgcatggcatcgcccatgggctggcgctgttcatcacagcccacctggtgtcgggagagtacctcgcggtctgcttcatcatcaaccacatctctgagtcatgcgactatttgaatccaagttccgtcatcgctgcgcggaggacggaaatgctgaagcaggcggagcaggaggccaaggcaaagcagaagcaccccaccccaccgcccaacgactgggccgcgtctcaggtactgtgctgcgtaaactggcgctctggtggctatttctcaaaccacctctcaggcgggctgaaccaccagatcgagcaccacctcttccccagcatctcacatgcgaactatccgaccattgccccagttgtgaaaggggtgtgcgaggagtacggcctcccctacaagaactactcccagttctccgacgctctctatggaatggtggagcacctcagggcgatgggcacgaagccggcagacaacgacaagctggcgcccaccgcgggctccctggaggacgtgtgcccggtcttgagcgccgccgttgctgcccaacctgacggaagcaccgacggcagcgctgcgggttgtccagcagtagccacactggcataaagggcataatgagcatgccatcatcactagacgacgttgctcaccttgttttccatttgtgccgtgccttgcggcccgtgttctccatttgcgggcactagattcggtacccagccctcctcacagctctgcgatttgagccgtttggggcaacgctccgctgacccttgtgcaggtcccccgaccatccgctccgaggaatgcggtaaaacaaaacaaataacaacagcatgaggcgtcaatctctgcgatatgcggggcttgctccagctcacctggaccacttcgtccgctgcgcagctatagttttgggccgcagctaggtctgcggttacttccttttttttctccggcgcagggcgcttggttctaagcctttcctccaatcctcgagccccctcgacctgaccgtgtcttcctctggctgaaagcggaggatgatttgtgcgttgctcagaaggaacctccatcggtggtggttttcgcatttcccattgatgtccaacagtgctgccattcagtttgacctgcaaaaaaaaaaaaaaaaaaaaaaaaaaaaaaaaaaacccaactttctt

SEQ ID NO: 89 - DNA, 5608 bp, Artificial Sequence
  plasmid pLF117-3
gtacaaagttggcattataagaaagcattgcttatcaatttgttgcaacgaacaggtcactatcagtcaaaataaaatcattatttgccatccagctgatatcccctatagtgagtcgtattacatggtcatagctgtttcctggcagctctggcccgtgtctcaaaatctctgatgttacattgcacaagataaaaatatatcatcatgttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcatagatcttttctccatcactgatagggagtggtaaaataactccatcaatgatagagtgtcaacaacatgaccaaaatcccttaacgtgagttacgcgtattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggttacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagggaacgacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttaacgctagcatggatgttttcccagtcacgacgttgtaaaacgacggccagtcttaagctcgggccccaaataatgattttattttgactgatagtgacctgttcgttgcaacaaattgatgagcaatgcttttttataatgccaactttgtacaaaaaagttggattttttttcggtctccatggccgaaggcaagagcgatgggcctgtggtgacccttcaaagcatgtggaaaccgcttgctttgatggcagtagatgtcggcatattggtcaatgtccgccgcaaggctttcactgagtttgatgggcacagcaacgtttttgcagatccagtttacattccatttgtgatgaatctcttctacttgaccatgatctttgctgggtgccgttggatgaagactcgcgagccctttgagatcaagtcatatatgtttgcatacaatgcatatcagacaatgatgaacttcctcattgtcgtcgggttcatgtatgaggtgcacagcacagggatgcgatattgggggtccaggatcgacacctccaccaagggcttgggcctcggtttcctgatctatgcccactaccacaacaaatatgtggagtatgtcgacacgttgttcatgatcctgcgcaagaaaaacaaccagatctcgttcctccacgtctaccaccattcgcttttgacttgggcctggtgggccgtggtctactgggccccgggaggagatgcctggttcggagcatgctacaattccttcatccacgtgctgatgtactcctactacctgtttgcaacgtttggcatcaggtgcccctggaagaagatgctgacccagttgcagatggtgcaattctgcttctgctttgcccacgcgatgtatgttggatggctgggccatgaagtctacccgcgctggttgacggcgctgcaggcatttgtgatgctaaacatgctggtgctgttcggcaacttctacatgaagtcgtactccaaggccagcaagctggagccggcctcccccgcgtcccccgcctccctcgcccagaaaccgttcgagaacgccaaggtgaagcctgggggccccggcaagccaagcgagattgcgtcgctgccaccgccaattcgaccagtcgggaacccacctgcagcctactacgatgccctggcgacctcgggcaccgggcaggaccgcaagttcaccatgcgggaggtggcccgccatattgtgccgaccgacgggtggttggcatgccatgacggtgtctacgacatcaccgagttcatagggaaacatcctggcggcgatgttatttctctcggattgggcagggactccacaatcctggttgagtcgtaccaccctgccggaaggccagacaaggtcatggaaaagtaccgcatcgggacgctccaggaccaccgcacgttctacgactggcaggcctccgcgttctacgccgagctgaagcagcgggtggtgcagacgctaaaggaggccggccaaccgcggcgtgggggcctgtcggtcaaagcggcgctggtcatggcagcgttcgcggcgtcgttctacctcatggtgacccagggatccttcttctgggccgccgtctggggcctcgccggctcccacattggcctcagcatccagcacgacgggaaccacggggctttcagtaagagtggtcggctgaaccgcctcgcaggctggggcatggacgttatcggggcctcctcgacggcctgggagtaccagcacgtcatcgggcaccaccagtacaccaacctggtatcggatcccgagttcgcgctgcctgagaacgacccggacgtcttcggcacctatccgctgatgcggatgcatccggacaccccttggaagccgcaccaccagctgcagcatatgtacgcgttcccgctgttcgccctgatgaccatcagcaaggtcatcatcagtgacttcacgttctgcctcgccaagcggcgcgggccgatcgacttctccgccaggctcgtgccacttgaggggcagatgctcttctggggcgcgaagatcatggggttcctgatgcagatagtcctgccgtgctatctgcatggcatcgcccatgggctggcgctgttcatcacagcccacctggtgtcgggagagtacctcgcggtctgcttcatcatcaaccacatctctgagtcatgcgactatttgaatccaagttccgtcatcgctgcgcggcggacggaaatgctgaagcaggcggagcaggaggccaaggcaaagcagaagcaccccaccccaccgcccaacgactgggccgcgtctcaggtactgtgctgcgtaaactggcgctctggtggatatttctcaaaccacctctcaggcgggctgaaccaccagatcgagcaccacctcttccccagcatctcacatgcgaactatccgaccattgccccagttgtgaaaggggtgtgcgaggagtacggcctcccctacaagaactactcccagttctctgacgctatctatggaatggtggagcacctcagggcgatgggcacgaagcccgaagacaacggcaagctggcgccactgccgggctccctggaggacgtgtgcccggtcctgagtgccgccgttgctgcccaacctgacggaagcaccgacggcagcgctgcgggttgtccagcagtagccacactggcataaagggcataatgagcaatgccatcatcactagacgacgttgctcaccttgttttccatttgtgccgtgccttgcggcccgtgttctgcatttgcgggcactagattcggtacccagccctcctcacagctctgcgatttgagccgtttgaggcaacgctccgctgacccttgtgcaggtcccccgaccatccgctccgaggagggcggtaaaacaaaacaaataacaacagcatgaggcgtcaatctctgcgatatgcggggcttgctccagctcacctggaccacttcgtccgctgcgcagctatagttttggggccgcagctaggtctgcggttacttcctttttttttctccggcgcagggcgcttggttctaagcctttcctccaatcctcgagccccctcgacctgaccgtgtcttcctctggctgaaagcggaggatgatttgtgcgttgctcagaaggaacctccatcggtggtggttttcgcatttcccattgatgtccaacagtgcttccattcagtttgaccaaaaaaaaaaaaaaaaaaaaaaaaaaaaaaaaaaaacccaactttctt

SEQ ID NO: 90 - DNA, 5557 bp, Artificial Sequence
  plasmid pLF117-4
gtacaaagttggcattataagaaagcattgcttatcaatttgttgcaacgaacaggtcactatcagtcaaaataaaatcattatttgccatccagctgatatcccctatagtgagtcgtattacatggtcatagctgtttcctggcagctctggcccgtgtctcaaaatctctgatgttacattgcacaagataaaaatatatcatcatgttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcatagatcttttctccatcactgatagggagtggtaaaataactccatcaatgatagagtgtcaacaacatgaccaaaatcccttaacgtgagttacgcgtattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggttacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagggaacgacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttaacgctagcatggatgttttcccagtcacgacgttgtaaaacgacggccagtcttaagctcgggccccaaataatgattttattttgactgatagtgacctgttcgttgcaacaaattgatgagcaatgcttttttataatgccaactttgtacaaaaaagttggattttttttcggtctccatggccgaaggcaagagcgatgggcctgtggtgacccttcaaagcatgtggaaaccgcttgctttgatggcagtagatgtcggcatattggtcaacgtccgccgcaaggctttcactgagtttgatgggcacagcaacgtttttgcagatcccgtttacattccatttgtgatgaatctcttctacttgaccatgatctttgctgggtgccgttggatgaagactcgcgaaccctttgagatcaagtcatatatgtttgcatacaatgcatatcagacgatgatgaacttcctcattgtcgtcgggttcatgtatgaggtgcacagcacagggatgcggtattgggggtccaggatcgacacctccaccaagggcttgggcctcggtttcctgatctatgcccactaccacaacaaatacgtggagtatgtcgacacgttgttcatgatcctgcgcaagaaaaacaaccagatctcgttcctccacgtctaccaccattcgcttttgacttgggcctggtgggccgtggtctactgggccccaggaggagatgcctggttcggagcatgctacaattcctttatccacgtgctgatgtactcctactacctgtttgcaacgtttggcatcaggtgcccctggaagaagatgctgacccagttgcagatggtgcaattctgcttctgctttgcccacgcgatgtatgttggatggctgggccatgaagtctacccgcgctggttgacggcgctacaggcatttgtgatgctaaacatgctggtgctgttcggcaacttctacatgaagtcgtactccaaggccagcaagctggagccggcctcccccgtgtcccccgcctccctcgcccagaagccgttcgagaacgccaaggtgaagcctgggggccccggcaagccaagcgagattgcgtcgctgccaccgccaattcgaccagtcgggaacccacctgcagcctactacgatgccctggcgacctcgggcaccgggcaggaccgcaagttcaccatgcgggaggtggcccgccatattgtgccgaccgatgggtggttggcgtgccatgacggtgtctacgacatcaccgagttcatagggaaacatcctggcggcgatgttatttctctcggattgggcagggactccacaatcctggttgagtcgtaccaccctgccggaaggccagacaaggtcatggaaaagtaccgcatcgggacgctccaggaccaccgcacgttctacgactggcaggcctccgcgttctacgccgagctgaagcagcgggtggtgcagacgctaaaggaggccggccaaccgcggcgtgggggcctgtcggtcaaagcggcgctggtcatggcggcgttcgcagcgtcgttctacctcatggtgacccagggatccttcttctgggccgccgtctggggcctcgccggctcccacattggcctcagcatccagcacgacgggaaccacggggctttcagtaagagtggtcggctgaaccgcctcgcgggctggggcatggacgtcatcggggcctcctcgacggcctgggagtaccagcacgtcatcgggcaccaccagtacaccaacctggtatcggatcccgagttcgcgctgcctgagaacgacccggacgtcttcggcacctatccgctgatgcggatgcatccggacaccccttggaagccgcaccaccagctgcagcatatgtacgcgttcccgctgttcgccctgatgaccatcagcaaggtcatcatcagcgacttcacgttctgcctcgccaagcggcgcgggccgatcgacttctccgccaggctcgtgccacttgaggggcagatgctcttctggggggcgaagatcatggggttcctgatgcagatagtcctgccgtgctatctgcatggcatcgcccatgggctggcgctgttcatcacagcccacctggtgtcgggagagtacctcgcggtctgcttcatcatcaaccacatctctgagtcatgcgactatttgaatccaagttccgtcatcgctgcgcggcggacggaaatgctgaagcaggcggagcaggaggccaaggcaaagcagaagcaccccaccccaccgcccaacgactgggccgcgtctcaggtactgtgctgcgtaaactggcgctctggtggatatttctcaaaccacctctcaggcgggctgaaccaccagatcgagcaccacctcttccccagcatctcacatgcgaactatccgaccattgccccagttgtgaaaagggtgtgcgaggagtacggcctcccctacaagaactactcccagttctctgacctctctatggaatggtggagcacctcagggcgatgggcacgaagccggcagacaacgacaagctggcgccaccactgggctccctggaggacgtgtgcccggtcctgagtgccgccgttgctgcccaacctgacggaagcaccgacggcagcgctgcaggttgtccagcagtagccacactggcataaagggcataatgagcatgccatcatcactagacgacgttgctcaccttgttttccatttgtgccgtgccttgcggcccgtgttctgcatttgcgggcactagattcggtacccagccctcctcacagctctgcgatttgagccgtttgaggcaacgctccgctgacccttgtgcaggtcccccgaccatccgctccgaggagggcggtaaaacaaaacaaataacaacagcatgaggcgtcaatctctgcgatatgcggggcttgctccagctcacctggaccacttcgtccgctgcgcagctatagttttggggccgcagctaggtctgcggttacttccttttttttttctccggcgcagggcgcttggttctaagcctttcctccaatcctcgagccccctcgacctgaccgtgtcttcctctggctgaaagcggaggatgatttgtgcgttgctcagaaggaacctccatcggtggtggttttcgcatttcccaaaaaaaaaaaaaaaaaaaaacccaactttctt

SEQ ID NO: 91 - DNA, 2523 bp, Euglena anabaena
atggccgaaggcaagagcgatgggcctgtggtgacccttcaaagcatgtggaaaccgcttgctttgatggcagtagatgtcggcatattggtcaatgtccgccgcaaggctttcactgagtttgatgggcacagcaacgtttttgcagatccagtttacattccatttgtgatgaatctcttctacttgaccatgatctttgctgggtgccgttggatgaagactcgcgagccctttgagatcaagtcatatatgtttgcatacaatgcatatcagacaatgatgaacttcctcattgtcgtcgggttcatgtatgaggtgcacagcacagggatgcgatattgggggtccaggatcgacacctccaccaagggcttgggcctcggtttcctgatctatgcccactaccacaacaaatatgtggagtatgtcgacacgttgttcatgatcctgcgcaagaaaaacaaccagatctcgttcctccacgtctaccaccattcgcttttgacttgggcctggtgggccgtggtctactgggccccgggaggagatgcctggttcggagcatgctacaattccttcatccacgtgctgatgtactcctactacctgtttgcaacgtttggcatcaggtgcccctggaagaagatgctgacccagttgcagatggtgcaattctgcttctgctttgcccacgcgatgtatgttggatggctgggccatgaagtctacccgcgctggttgacggcgctgcaggcatttgtgatgctaaacatgctggtgctgttcggcaacttctacatgaagtcgtactccaaggccagcaagctggagccggcctcccccgtgtcccccgcctccctcgcccagaaaccgttcgagaacgccaaggtgaagcctgggggccccggcaagccaagcgagattgcgtcgctgccaccgccaattcgaccagtcgggaacccacctgcagcctactacgatgccctggcgacctcgggcaccgggcaggaccgcaagttcaccatgcgggaggtggcccgccatattgtgccgaccgacgggtggttggcatgccatgacggtgtctacgacatcaccgagttcatagggaaacatcctggcggcgatgttatttctctcggattgggcagggactccacaatcctggttgagtcgtaccaccctgccggaaggccagacaaggtcatggaaaagtaccgcatcgggacgctccaggaccaccgcacgttctacgactggcaggcctccgcgttctacgccgagctgaagcagcgggtggtgcagacgctaaaggaggccggccaaccgcggcgtgggggcctgtcggtcaaagcggcgctggtcatggcagcgttcgcggcgtcgttctacctcatggtgacccagggatccttcttctgggccgccgtctggggcctcgccggctcccacattggcctcagcatccagcacgacgggaaccacggggctttcagtaagagtggtcggctgaaccgcctcgcaggctggggcatggacgttatcggggcctcctcgacggcctgggagtaccagcacgtcatcgggcaccaccagtacaccaacctggtatcggatcccgagttcgcgctgcctgagaacgacccggacgtcttcggcacctatccgctgatgcggatgcatccggacaccccttggaagccgcaccaccagctgcagcatatgtacgcgttcccgctgttcgccctgatgaccatcagcaaggtcatcatcagtgacttcacgttctgcctcgccaagcggcgcgggccgatcgacttctccgccaggctcgtgccacttgaggggcagatgctcttctggggcgcgaagatcatggggttcctgatgcagatagtcctgccgtgctatctgcatggcatcgcccatgggctggcgctgttcatcacagcccacctggtgtcgggagagtacctcgcggtctgcttcatcatcaaccacatctctgagtcatgcgactatttgaatccaagttccgtcatcgctgcgcggcggacggaaatgctgaagcaggcggagcaggaggccaaggcaaagcagaagcaccccaccccaccgcccaacgactgggccgcgtctcaggtactgtgctgcgtaaactggcgctctggtggatatttctcaaaccacctctcaggcgggctgaaccaccagatcgagcaccacctcttccccagcatctcacatgcgaactatccgaccattgccccagttgtgaaaggggtgtgcgaggagtacggcctcccctacaagaactactcccagttctctgacgctatctatggaatggtggagcacctcagggcgatgggcacgaagcccgaagacaacggcaagctggcgccactgccgggctccctggaggacgtgtgcccggtcctgagtgccgccgttgctgcccaacctgacggaagcaccgacggcagcgctgcgggttgtccagcagtagccacactggca

SEQ ID NO: 92 - DNA, 2523 bp, Euglena anabaena
atggccgaaggcaagagcgatgggcctgtggtgacccttcaaagcatgtggaaaccgcttgctctgatggcaatagatgtcggcatattggtcaatgtccgccgcaaggctttcactgagtttgatgggcacagcaacgttttcgcagatccagtttacattccatttgtgatgaatctcttctacttgaccatgatctttgctgggtgccgttggatgaagactcgcgaaccctttgagatcaagtcatatatgtttgcatacaatgcatatcagacaatgatgaacttcctcattgtcgtcgggttcatgtatgaggtgcacagcacagggatgcgatattgggggtccaggatcgacacctccaccaagggcttgggcctcggtttcctgatctatgcccactaccacaacaaatacgtggagtatgtcgacacgttgttcatgatcctgcgcaagaaaaacaaccagatctcgttcctccacgtctaccaccattcgcttttgacttgggcctggtgggccgtggtctactgggccccaggaggagatgcctggttcggagcatgctacaattccttcatccacgtgctgatgtactcctactacctgtttgcaacgtttggcatcaggtgcccctggaagaagatgctgacccagttgcagatggtgcaattctgcttctgctttgcccacgcgatgtatgttggatggctgggccatgaagtctacccgcgctggttgacggcgctacaggcatttgtgatgctaaacatgctggtgctgttcggcaacttctacatgaagtcgtactccaaggccagcaagctggagccggcctcccccgtgtcccccgcctccctcgcccagaagccgttcgagaacgccaaggtgaagcctgggggccccggcaagccaagcgagattgcgtcgctgccaccgccaattcgaccagtcgggaacccacctgcagcctactacgatgccctggcgacctcgggcaccgggcaggaccgcaagttcaccatgcgggaggtggcccgccatattgtgccgaccgatgggtggttggcgtgccatgacggtgtctacgacatcaccgagttcatagggaaacatcctggcggcgatgttatttctctcggattgggcagggactccacaatcctggttgagtcgtaccaccctgccggaaggccagacaaggtcatggaaaagtaccgcatcgggacgctccaggaccaccgcacgttctacgactggcaggcctccgcgttctacgccgagctgaagcagcgggtggtgcagacgctaaaggaggccggccaaccgcggcgtgggggcctgtcggtcaaagcggcgctggtcatggcggcgttcgcagcgtcgttctacctcatggtgacccagggatccttcttctgggccgccgtctggggcctcgccggctcccacattggcctcagcatccagcacgacgggaaccacggggctttcagtaagagtggtcggctgaaccgcctcgcgggctggggcatggacgtcatcggggcctcctcgacggcctgggagtaccagcacgtcatcgggcaccaccagtacaccaacctggtatcggatcccgagttcgcgctgcctgagaacgacccggacgtcttcggcacctatccgctgatgcggatgcatccggacaccccttggaagccgcaccaccagctgcagcatgtgtacgcgttcccgctgttcgccctgatgaccatcagcaaggtcatcatcagcgacttcacgttctgcctcgccaagcggcgcgggccgatcgacttctccgccaggctcgtgccacttgaggggcagatgctcttctggggggcgaagatcatggggttcctgatgcagatagtcctgccgtgctatctgcatggcatcgcccatgggctggcgctgttcatcacagcccacctggtgtcgggagagtacctcgcggtctgcttcatcatcaaccacatctctgagtcatgcgactatttgaatccaagttccgtcatcgctgcgcggaggacggaaatgctgaagcaggcggagcaggaggccaaggcaaagcagaagcaccccaccccaccgcccaacgactgggccgcgtctcaggtactgtgctgcgtaaactggcgctctggtggctatttctcaaaccacctctcaggcgggctgaaccaccagatcgagcaccacctcttccccagcatctcacatgcgaactatccgaccattgccccagttgtgaaaggggtgtgcgaggagtacggcctcccctacaagaactactcccagttctccgacgctctctatggaatggtggagcacctcagggcgatgggcacgaagccggcagacaacgacaagctggcgcccaccgcgggctccctggaggacgtgtgcccggtcttgagcgccgccgttgctgcccaacctgacggaagcaccgacggcagcgctgcgggttgtccagcagtagccacactggca

SEQ ID NO: 93 - DNA, 2523 bp, Euglena anabaena
atggccgaaggcaagagcgatgggcctgtggtgacccttcaaagcatgtggaaaccgcttgctttgatggcagtagatgtcggcatattggtcaatgtccgccgcaaggctttcactgagtttgatgggcacagcaacgtttttgcagatccagtttacattccatttgtgatgaatctcttctacttgaccatgatctttgctgggtgccgttggatgaagactcgcgagccctttgagatcaagtcatatatgtttgcatacaatgcatatcagacaatgatgaacttcctcattgtcgtcgggttcatgtatgaggtgcacagcacagggatgcgatattgggggtccaggatcgacacctccaccaagggcttgggcctcggtttcctgatctatgcccactaccacaacaaatatgtggagtatgtcgacacgttgttcatgatcctgcgcaagaaaaacaaccagatctcgttcctccacgtctaccaccattcgcttttgacttgggcctggtgggccgtggtctactgggccccgggaggagatgcctggttcggagcatgctacaattccttcatccacgtgctgatgtactcctactacctgtttgcaacgtttggcatcaggtgcccctggaagaagatgctgacccagttgcagatggtgcaattctgcttctgctttgcccacgcgatgtatgttggatggctgggccatgaagtctacccgcgctggttgacggcgctgcaggcatttgtgatgctaaacatgctggtgctgttcggcaacttctacatgaagtcgtactccaaggccagcaagctggagccggcctcccccgcgtcccccgcctccctcgcccagaaaccgttcgagaacgccaaggtgaagcctgggggccccggcaagccaagcgagattgcgtcgctgccaccgccaattcgaccagtcgggaacccacctgcagcctactacgatgccctggcgacctcgggcaccgggcaggaccgcaagttcaccatgcgggaggtggcccgccatattgtgccgaccgacgggtggttggcatgccatgacggtgtctacgacatcaccgagttcatagggaaacatcctggcggcgatgttatttctctcggattgggcagggactccacaatcctggttgagtcgtaccaccctgccggaaggccagacaaggtcatggaaaagtaccgcatcgggacgctccaggaccaccgcacgttctacgactggcaggcctccgcgttctacgccgagctgaagcagcgggtggtgcagacgctaaaggaggccggccaaccgcggcgtgggggcctgtcggtcaaagcggcgctggtcatggcagcgttcgcggcgtcgttctacctcatggtgacccagggatccttcttctgggccgccgtctggggcctcgccggctcccacattggcctcagcatccagcacgacgggaaccacggggctttcagtaagagtggtcggctgaaccgcctcgcaggctggggcatggacgttatcggggcctcctcgacggcctgggagtaccagcacgtcatcgggcaccaccagtacaccaacctggtatcggatcccgagttcgcgctgcctgagaacgacccggacgtcttcggcacctatccgctgatgcggatgcatccggacaccccttggaagccgcaccaccagctgcagcatatgtacgcgttcccgctgttcgccctgatgaccatcagcaaggtcatcatcagtgacttcacgttctgcctcgccaagcggcgcgggccgatcgacttctccgccaggctcgtgccacttgaggggcagatgctcttctggggcgcgaagatcatggggttcctgatgcagatagtcctgccgtgctatctgcatggcatcgcccatgggctggcgctgttcatcacagcccacctggtgtcgggagagtacctcgcggtctgcttcatcatcaaccacatctctgagtcatgcgactatttgaatccaagttccgtcatcgctgcgcggcggacggaaatgctgaagcaggcggagcaggaggccaaggcaaagcagaagcaccccaccccaccgcccaacgactgggccgcgtctcaggtactgtgctgcgtaaactggcgctctggtggatatttctcaaaccacctctcaggcgggctgaaccaccagatcgagcaccacctcttccccagcatctcacatgcgaactatccgaccattgccccagttgtgaaaggggtgtgcgaggagtacggcctcccctacaagaactactcccagttctctgacgctatctatggaatggtggagcacctcagggcgatgggcacgaagcccgaagacaacggcaagctggcgccactgccgggctccctggaggacgtgtgcccggtcctgagtgccgccgttgctgcccaacctgacggaagcaccgacggcagcgctgcgggttgtccagcagtagccacactggca

SEQ ID NO: 94 - DNA, 2442 bp, Euglena anabaena
atggccgaaggcaagagcgatgggcctgtggtgacccttcaaagcatgtggaaaccgcttgctttgatggcagtagatgtcggcatattggtcaacgtccgccgcaaggctttcactgagtttgatgggcacagcaacgtttttgcagatcccgtttacattccatttgtgatgaatctcttctacttgaccatgatctttgctgggtgccgttggatgaagactcgcgaaccctttgagatcaagtcatatatgtttgcatacaatgcatatcagacgatgatgaacttcctcattgtcgtcgggttcatgtatgaggtgcacagcacagggatgcggtattgggggtccaggatcgacacctccaccaagggcttgggcctcggtttcctgatctatgcccactaccacaacaaatacgtggagtatgtcgacacgttgttcatgatcctgcgcaagaaaaacaaccagatctcgttcctccacgtctaccaccattcgcttttgacttgggcctggtgggccgtggtctactgggccccaggaggagatgcctggttcggagcatgctacaattcctttatccacgtgctgatgtactcctactacctgtttgcaacgtttggcatcaggtgcccctggaagaagatgctgacccagttgcagatggtgcaattctgcttctgctttgcccacgcgatgtatgttggatggctgggccatgaagtctacccgcgctggttgacggcgctacaggcatttgtgatgctaaacatgctggtgctgttcggcaacttctacatgaagtcgtactccaaggccagcaagctggagccggcctcccccgtgtcccccgcctccctcgcccagaagccgttcgagaacgccaaggtgaagcctgggggccccggcaagccaagcgagattgcgtcgctgccaccgccaattcgaccagtcgggaacccacctgcagcctactacgatgccctggcgacctcgggcaccgggcaggaccgcaagttcaccatgcgggaggtggcccgccatattgtgccgaccgatgggtggttggcgtgccatgacggtgtctacgacatcaccgagttcatagggaaacatcctggcggcgatgttatttctctcggattgggcagggactccacaatcctggttgagtcgtaccaccctgccggaaggccagacaaggtcatggaaaagtaccgcatcgggacgctccaggaccaccgcacgttctacgactggcaggcctccgcgttctacgccgagctgaagcagcgggtggtgcagacgctaaaggaggccggccaaccgcggcgtgggggcctgtcggtcaaagcggcgctggtcatggcggcgttcgcagcgtcgttctacctcatggtgacccagggatccttcttctgggccgccgtctggggcctcgccggctcccacattggcctcagcatccagcacgacgggaaccacggggctttcagtaagagtggtcggctgaaccgcctcgcgggctggggcatggacgtcatcggggcctcctcgacggcctgggagtaccagcacgtcatcgggcaccaccagtacaccaacctggtatcggatcccgagttcgcgctgcctgagaacgacccggacgtcttcggcacctatccgctgatgcggatgcatccggacaccccttggaagccgcaccaccagctgcagcatatgtacgcgttcccgctgttcgccctgatgaccatcagcaaggtcatcatcagcgacttcacgttctgcctcgccaagcggcgcgggccgatcgacttctccgccaggctcgtgccacttgaggggcagatgctcttctggggggcgaagatcatggggttcctgatgcagatagtcctgccgtgctatctgcatggcatcgcccatgggctggcgctgttcatcacagcccacctggtgtcgggagagtacctcgcggtctgcttcatcatcaaccacatctctgagtcatgcgactatttgaatccaagttccgtcatcgctgcgcggcggacggaaatgctgaagcaggcggagcaggaggccaaggcaaagcagaagcaccccaccccaccgcccaacgactgggccgcgtctcaggtactgtgctgcgtaaactggcgctctggtggatatttctcaaaccacctctcaggcgggctgaaccaccagatcgagcaccacctcttccccagcatctcacatgcgaactatccgaccattgccccagttgtgaaaagggtgtgcgaggagtacggcctcccctacaagaactactcccagttctctgacctctctatggaatggtggagcacctcagggcgatgggcacgaagccggcagacaacgacaagctggcgccaccactgggctccctggaggacgtgtgcccggtcc

SEQ ID NO: 95 - protein, 841 aa, Euglena anabaena
MAEGKSDGPVVTLQSMWKPLALMAVDVGILVNVRRKAFTEFDGHSNVFADPVYIPFVMNLFYLTMIFAGCRWMKTREPFEIKSYMFAYNAYQTMMNFLIVVGFMYEVHSTGMRYWGSRIDTSTKGLGLGFLIYAHYHNKYVEYVDTLFMILRKKNNQISFLHVYHHSLLTWAWWAVVYWAPGGDAWFGACYNSFIHVLMYSYYLFATFGIRCPWKKMLTQLQMVQFCFCFAHAMYVGWLGHEVYPRWLTALQAFVMLNMLVLFGNFYMKSYSKASKLEPASPVSPASLAQKPFENAKVKPGGPGKPSEIASLPPPIRPVGNPPAAYYDALATSGTGQDRKFTMREVARHIVPTDGWLACHDGVYDITEFIGKHPGGDVISLGLGRDSTILVESYHPAGRPDKVMEKYRIGTLQDHRTFYDWQASAFYAELKQRVVQTLKEAGQPRRGGLSVKAALVMAAFAASFYLMVTQGSFFWAAVWGLAGSHIGLSIQHDGNHGAFSKSGRLNRLAGWGMDVIGASSTAWEYQHVIGHHQYTNLVSDPEFALPENDPDVFGTYPLMRMHPDTPWKPHHQLQHMYAFPLFALMTISKVIISDFTFCLAKRRGPIDFSARLVPLEGQMLFWGAKIMGFLMQIVLPCYLHGIAHGLALFITAHLVSGEYLAVCFIINHISESCDYLNPSSVIAARRTEMLKQAEQEAKAKQKHPTPPPNDWAASQVLCCVNWRSGGYFSNHLSGGLNHQIEHHLFPSISHANYPTIAPVVKGVCEEYGLPYKNYSQFSDAIYGMVEHLRAMGTKPEDNGKLAPLPGSLEDVCPVLSAAVAAQPDGSTDGSAAGCPAVATLA

SEQ ID NO: 96 - protein, 841 aa, Euglena anabaena
MAEGKSDGPVVTLQSMWKPLALMAIDVGILVNVRRKAFTEFDGHSNVFADPVYIPFVMNLFYLTMIFAGCRWMKTREPFEIKSYMFAYNAYQTMMNFLIVVGFMYEVHSTGMRYWGSRIDTSTKGLGLGFLIYAHYHNKYVEYVDTLFMILRKKNNQISFLHVYHHSLLTWAWWAVVYWAPGGDAWFGACYNSFIHVLMYSYYLFATFGIRCPWKKMLTQLQMVQFCFCFAHAMYVGWLGHEVYPRWLTALQAFVMLNMLVLFGNFYMKSYSKASKLEPASPVSPASLAQKPFENAKVKPGGPGKPSEIASLPPPIRPVGNPPAAYYDALATSGTGQDRKFTMREVARHIVPTDGWLACHDGVYDITEFIGKHPGGDVISLGLGRDSTILVESYHPAGRPDKVMEKYRIGTLQDHRTFYDWQASAFYAELKQRVVQTLKEAGQPRRGGLSVKAALVMAAFAASFYLMVTQGSFFWAAVWGLAGSHIGLSIQHDGNHGAFSKSGRLNRLAGWGMDVIGASSTAWEYQHVIGHHQYTNLVSDPEFALPENDPDVFGTYPLMRMHPDTPWKPHHQLQHVYAFPLFALMTISKVIISDFTFCLAKRRGPIDFSARLVPLEGQMLFWGAKIMGFLMQIVLPCYLHGIAHGLALFITAHLVSGEYLAVCFIINHISESCDYLNPSSVIAARRTEMLKQAEQEAKAKQKHPTPPPNDWAASQVLCCVNWRSGGYFSNHLSGGLNHQIEHHLFPSISHANYPTIAPVVKGVCEEYGLPYKNYSQFSDALYGMVEHLRAMGTKPADNDKLAPTAGSLEDVCPVLSAAVAAQPDGSTDGSAAGCPAVATLA

SEQ ID NO: 97 - protein, 841 aa, Euglena anabaena
MAEGKSDGPVVTLQSMWKPLALMAVDVGILVNVRRKAFTEFDGHSNVFADPVYIPFVMNLFYLTMIFAGCRWMKTREPFEIKSYMFAYNAYQTMMNFLIVVGFMYEVHSTGMRYWGSRIDTSTKGLGLGFLIYAHYHNKYVEYVDTLFMILRKKNNQISFLHVYHHSLLTWAWWAVVYWAPGGDAWFGACYNSFIHVLMYSYYLFATFGIRCPWKKMLTQLQMVQFCFCFAHAMYVGWLGHEVYPRWLTALQAFVMLNMLVLFGNFYMKSYSKASKLEPASPASPASLAQKPFENAKVKPGGPGKPSEIASLPPPIRPVGNPPAAYYDALATSGTGQDRKFTMREVARHIVPTDGWLACHDGVYDITEFIGKHPGGDVISLGLGRDSTILVESYHPAGRPDKVMEKYRIGTLQDHRTFYDWQASAFYAELKQRVVQTLKEAGQPRRGGLSVKAALVMAAFAASFYLMVTQGSFFWAAVWGLAGSHIGLSIQHDGNHGAFSKSGRLNRLAGWGMDVIGASSTAWEYQHVIGHHQYTNLVSDPEFALPENDPDVFGTYPLMRMHPDTPWKPHHQLQHMYAFPLFALMTISKVIISDFTFCLAKRRGPIDFSARLVPLEGQMLFWGAKIMGFLMQIVLPCYLHGIAHGLALFITAHLVSGEYLAVCFIINHISESCDYLNPSSVIAARRTEMLKQAEQEAKAKQKHPTPPPNDWAASQVLCCVNWRSGGYFSNHLSGGLNHQIEHHLFPSISHANYPTIAPVVKGVCEEYGLPYKNYSQFSDAIYGMVEHLRAMGTKPEDNGKLAPLPGSLEDVCPVLSAAVAAQPDGSTDGSAAGCPAVATLA

SEQ ID NO: 98 - protein, 814 aa, Euglena anabaena
MAEGKSDGPVVTLQSMWKPLALMAVDVGILVNVRRKAFTEFDGHSNVFADPVYIPFVMNLFYLTMIFAGCRWMKTREPFEIKSYMFAYNAYQTMMNFLIVVGFMYEVHSTGMRYWGSRIDTSTKGLGLGFLIYAHYHNKYVEYVDTLFMILRKKNNQISFLHVYHHSLLTWAWWAVVYWAPGGDAWFGACYNSFIHVLMYSYYLFATFGIRCPWKKMLTQLQMVQFCFCFAHAMYVGWLGHEVYPRWLTALQAFVMLNMLVLFGNFYMKSYSKASKLEPASPVSPASLAQKPFENAKVKPGGPGKPSEIASLPPPIRPVGNPPAAYYDALATSGTGQDRKFTMREVARHIVPTDGWLACHDGVYDITEFIGKHPGGDVISLGLGRDSTILVESYHPAGRPDKVMEKYRIGTLQDHRTFYDWQASAFYAELKQRVVQTLKEAGQPRRGGLSVKAALVMAAFAASFYLMVTQGSFFWAAVWGLAGSHIGLSIQHDGNHGAFSKSGRLNRLAGWGMDVIGASSTAWEYQHVIGHHQYTNLVSDPEFALPENDPDVFGTYPLMRMHPDTPWKPHHQLQHMYAFPLFALMTISKVIISDFTFCLAKRRGPIDFSARLVPLEGQMLFWGAKIMGFLMQIVLPCYLHGIAHGLALFITAHLVSGEYLAVCFIINHISESCDYLNPSSVIAARRTEMLKQAEQEAKAKQKHPTPPPNDWAASQVLCCVNWRSGGYFSNHLSGGLNHQIEHHLFPSISHANYPTIAPVVKRVCEEYGLPYKNYSQFSDLSMEWWSTSGRWARSRQTTTSWRHHWAPWRTCARS

SEQ ID NO: 99 - DNA, 10133 bp, Artificial Sequence
  plasmid pY165
  misc_feature (10084)..(10123): n is a, c, g, or t
cttgtacaaagtggtgatggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttagcaaaaagtgaaggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccagcggccatcacaagtttgtacaaaaaagttggattttttttcggtctccatggccgaaggcaagagcgatgggcctgtggtgacccttcaaagcatgtggaaaccgcttgctttgatggcagtagatgtcggcatattggtcaatgtccgccgcaaggctttcactgagtttgatgggcacagcaacgtttttgcagatccagtttacattccatttgtgatgaatctcttctacttgaccatgatctttgctgggtgccgttggatgaagactcgcgagccctttgagatcaagtcatatatgtttgcatacaatgcatatcagacaatgatgaacttcctcattgtcgtcgggttcatgtatgaggtgcacagcacagggatgcgatattgggggtccaggatcgacacctccaccaagggcttgggcctcggtttcctgatctatgcccactaccacaacaaatatgtggagtatgtcgacacgttgttcatgatcctgcgcaagaaaaacaaccagatctcgttcctccacgtctaccaccattcgcttttgacttgggcctggtgggccgtggtctactgggccccgggaggagatgcctggttcggagcatgctacaattccttcatccacgtgctgatgtactcctactacctgtttgcaacgtttggcatcaggtgcccctggaagaagatgctgacccagttgcagatggtgcaattctgcttctgctttgcccacgcgatgtatgttggatggctgggccatgaagtctacccgcgctggttgacggcgctgcaggcatttgtgatgctaaacatgctggtgctgttcggcaacttctacatgaagtcgtactccaaggccagcaagctggagccggcctcccccgtgtcccccgcctccctcgcccagaaaccgttcgagaacgccaaggtgaagcctgggggccccggcaagccaagcgagattgcgtcgctgccaccgccaattcgaccagtcgggaacccacctgcagcctactacgatgccctggcgacctcgggcaccgggcaggaccgcaagttcaccatgcgggaggtggcccgccatattgtgccgaccgacgggtggttggcatgccatgacggtgtctacgacatcaccgagttcatagggaaacatcctggcggcgatgttatttctctcggattgggcagggactccacaatcctggttgagtcgtaccaccctgccggaaggccagacaaggtcatggaaaagtaccgcatcgggacgctccaggaccaccgcacgttctacgactggcaggcctccgcgttctacgccgagctgaagcagcgggtggtgcagacgctaaaggaggccggccaaccgcggcgtgggggcctgtcggtcaaagcggcgctggtcatggcagcgttcgcggcgtcgttctacctcatggtgacccagggatccttcttctgggccgccgtctggggcctcgccggctcccacattggcctcagcatccagcacgacgggaaccacggggctttcagtaagagtggtcggctgaaccgcctcgcaggctggggcatggacgttatcggggcctcctcgacggcctgggagtaccagcacgtcatcgggcaccaccagtacaccaacctggtatcggatcccgagttcgcgctgcctgagaacgacccggacgtcttcggcacctatccgctgatgcggatgcatccggacaccccttggaagccgcaccaccagctgcagcatatgtacgcgttcccgctgttcgccctgatgaccatcagcaaggtcatcatcagtgacttcacgttctgcctcgccaagcggcgcgggccgatcgacttctccgccaggctcgtgccacttgaggggcagatgctcttctggggcgcgaagatcatggggttcctgatgcagatagtcctgccgtgctatctgcatggcatcgcccatgggctggcgctgttcatcacagcccacctggtgtcgggagagtacctcgcggtctgcttcatcatcaaccacatctctgagtcatgcgactatttgaatccaagttccgtcatcgctgcgcggcggacggaaatgctgaagcaggcggagcaggaggccaaggcaaagcagaagcaccccaccccaccgcccaacgactgggccgcgtctcaggtactgtgctgcgtaaactggcgctctggtggatatttctcaaaccacctctcaggcgggctgaaccaccagatcgagcaccacctcttccccagcatctcacatgcgaactatccgaccattgccccagttgtgaaaggggtgtgcgaggagtacggcctcccctacaagaactactcccagttctctgacgctatctatggaatggtggagcacctcagggcgatgggcacgaagcccgaagacaacggcaagctggcgccactgccgggctccctggaggacgtgtgcccggtcctgagtgccgccgttgctgcccaacctgacggaagcaccgacggcagcgctgcgggttgtccagcagtagccacactggcataaagggcataatgagcaatgccatcatcactagacgacgttgctcaccttgttttccatttgtgccgtgccttgcggcccgtgttctgcatttgcgggcactagattcggtacccagccctcctcacagctctgcgatttgagccgtttgaggcaacgctccgctgacccttgtgcaggtcccccgaccatccgctccgaggagggcggtaaaacaaaacaaataacaacagcatgaggcgtcaatctctgcgatatgcggggcttgctccagctcacctggaccacttcgtccgctgcgcagctatagttttggggccgcagctaggtctgcggttacttcctttttttttctccggcgcagggcgcttggttctaagcctttcctccaatcctcgagccccctcgacctgaccgtgtcttcctctggctgaaagcggaggatgatttgtgcgttgctcagaaggaacctccatcggtggtggttttcgcattcccattgannnnnnnnnnnnnnnnnnnnnnnnnnnnnnnnnnnnnnnnacccaacttt

SEQ ID NO: 100 - DNA, 10158 bp, Artificial Sequence
  plasmid pY166
cttgtacaaagtggtgatggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttagcaaaaagtgaaggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccagcggccatcacaagtttgtacaaaaaagttggattttttttcggtctccatggccgaaggcaagagcgatgggcctgtggtgacccttcaaagcatgtggaaaccgcttgctctgatggcaatagatgtcggcatattggtcaatgtccgccgcaaggctttcactgagtttgatgggcacagcaacgttttcgcagatccagtttacattccatttgtgatgaatctcttctacttgaccatgatctttgctgggtgccgttggatgaagactcgcgaaccctttgagatcaagtcatatatgtttgcatacaatgcatatcagacaatgatgaacttcctcattgtcgtcgggttcatgtatgaggtgcacagcacagggatgcgatattgggggtccaggatcgacacctccaccaagggcttgggcctcggtttcctgatctatgcccactaccacaacaaatacgtggagtatgtcgacacgttgttcatgatcctgcgcaagaaaaacaaccagatctcgttcctccacgtctaccaccattcgcttttgacttgggcctggtgggccgtggtctactgggccccaggaggagatgcctggttcggagcatgctacaattccttcatccacgtgctgatgtactcctactacctgtttgcaacgtttggcatcaggtgcccctggaagaagatgctgacccagttgcagatggtgcaattctgcttctgctttgcccacgcgatgtatgttggatggctgggccatgaagtctacccgcgctggttgacggcgctacaggcatttgtgatgctaaacatgctggtgctgttcggcaacttctacatgaagtcgtactccaaggccagcaagctggagccggcctcccccgtgtcccccgcctccctcgcccagaagccgttcgagaacgccaaggtgaagcctgggggccccggcaagccaagcgagattgcgtcgctgccaccgccaattcgaccagtcgggaacccacctgcagcctactacgatgccctggcgacctcgggcaccgggcaggaccgcaagttcaccatgcgggaggtggcccgccatattgtgccgaccgatgggtggttggcgtgccatgacggtgtctacgacatcaccgagttcatagggaaacatcctggcggcgatgttatttctctcggattgggcagggactccacaatcctggttgagtcgtaccaccctgccggaaggccagacaaggtcatggaaaagtaccgcatcgggacgctccaggaccaccgcacgttctacgactggcaggcctccgcgttctacgccgagctgaagcagcgggtggtgcagacgctaaaggaggccggccaaccgcggcgtgggggcctgtcggtcaaagcggcgctggtcatggcggcgttcgcagcgtcgttctacctcatggtgacccagggatccttcttctgggccgccgtctggggcctcgccggctcccacattggcctcagcatccagcacgacgggaaccacggggctttcagtaagagtggtcggctgaaccgcctcgcgggctggggcatggacgtcatcggggcctcctcgacggcctgggagtaccagcacgtcatcgggcaccaccagtacaccaacctggtatcggatcccgagttcgcgctgcctgagaacgacccggacgtcttcggcacctatccgctgatgcggatgcatccggacaccccttggaagccgcaccaccagctgcagcatgtgtacgcgttcccgctgttcgccctgatgaccatcagcaaggtcatcatcagcgacttcacgttctgcctcgccaagcggcgcgggccgatcgacttctccgccaggctcgtgccacttgaggggcagatgctcttctggggggcgaagatcatggggttcctgatgcagatagtcctgccgtgctatctgcatggcatcgcccatgggctggcgctgttcatcacagcccacctggtgtcgggagagtacctcgcggtctgcttcatcatcaaccacatctctgagtcatgcgactatttgaatccaagttccgtcatcgctgcgcggaggacggaaatgctgaagcaggcggagcaggaggccaaggcaaagcagaagcaccccaccccaccgcccaacgactgggccgcgtctcaggtactgtgctgcgtaaactggcgctctggtggctatttctcaaaccacctctcaggcgggctgaaccaccagatcgagcaccacctcttccccagcatctcacatgcgaactatccgaccattgccccagttgtgaaaggggtgtgcgaggagtacggcctcccctacaagaactactcccagttctccgacgctctctatggaatggtggagcacctcagggcgatgggcacgaagccggcagacaacgacaagctggcgcccaccgcgggctccctggaggacgtgtgcccggtcttgagcgccgccgttgctgcccaacctgacggaagcaccgacggcagcgctgcgggttgtccagcagtagccacactggcataaagggcataatgagcatgccatcatcactagacgacgttgctcaccttgttttccatttgtgccgtgccttgcggcccgtgttctccatttgcgggcactagattcggtacccagccctcctcacagctctgcgatttgagccgtttggggcaacgctccgctgacccttgtgcaggtcccccgaccatccgctccgaggaatgcggtaaaacaaaacaaataacaacagcatgaggcgtcaatctctgcgatatgcggggcttgctccagctcacctggaccacttcgtccgctgcgcagctatagttttgggccgcagctaggtctgcggttacttccttttttttctccggcgcagggcgcttggttctaagcctttcctccaatcctcgagccccctcgacctgaccgtgtcttcctctggctgaaagcggaggatgatttgtgcgttgctcagaaggaacctccatcggtggtggttttcgcatttcccattgatgtccaacagtgctgccattcagtttgacctgcaaaaaaaaaaaaaaaaaaaaaaaaaaaaaaaaaaacccaacttt

SEQ ID NO: 101 - DNA, 10159 bp, Artificial Sequence
  plasmid pY167
cttgtacaaagtggtgatggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttagcaaaaagtgaaggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccagcggccatcacaagtttgtacaaaaaagttggattttttttcggtctccatggccgaaggcaagagcgatgggcctgtggtgacccttcaaagcatgtggaaaccgcttgctttgatggcagtagatgtcggcatattggtcaatgtccgccgcaaggctttcactgagtttgatgggcacagcaacgtttttgcagatccagtttacattccatttgtgatgaatctcttctacttgaccatgatctttgctgggtgccgttggatgaagactcgcgagccctttgagatcaagtcatatatgtttgcatacaatgcatatcagacaatgatgaacttcctcattgtcgtcgggttcatgtatgaggtgcacagcacagggatgcgatattgggggtccaggatcgacacctccaccaagggcttgggcctcggtttcctgatctatgcccactaccacaacaaatatgtggagtatgtcgacacgttgttcatgatcctgcgcaagaaaaacaaccagatctcgttcctccacgtctaccaccattcgcttttgacttgggcctggtgggccgtggtctactgggccccgggaggagatgcctggttcggagcatgctacaattccttcatccacgtgctgatgtactcctactacctgtttgcaacgtttggcatcaggtgcccctggaagaagatgctgacccagttgcagatggtgcaattctgcttctgctttgcccacgcgatgtatgttggatggctgggccatgaagtctacccgcgctggttgacggcgctgcaggcatttgtgatgctaaacatgctggtgctgttcggcaacttctacatgaagtcgtactccaaggccagcaagctggagccggcctcccccgcgtcccccgcctccctcgcccagaaaccgttcgagaacgccaaggtgaagcctgggggccccggcaagccaagcgagattgcgtcgctgccaccgccaattcgaccagtcgggaacccacctgcagcctactacgatgccctggcgacctcgggcaccgggcaggaccgcaagttcaccatgcgggaggtggcccgccatattgtgccgaccgacgggtggttggcatgccatgacggtgtctacgacatcaccgagttcatagggaaacatcctggcggcgatgttatttctctcggattgggcagggactccacaatcctggttgagtcgtaccaccctgccggaaggccagacaaggtcatggaaaagtaccgcatcgggacgctccaggaccaccgcacgttctacgactggcaggcctccgcgttctacgccgagctgaagcagcgggtggtgcagacgctaaaggaggccggccaaccgcggcgtgggggcctgtcggtcaaagcggcgctggtcatggcagcgttcgcggcgtcgttctacctcatggtgacccagggatccttcttctgggccgccgtctggggcctcgccggctcccacattggcctcagcatccagcacgacgggaaccacggggctttcagtaagagtggtcggctgaaccgcctcgcaggctggggcatggacgttatcggggcctcctcgacggcctgggagtaccagcacgtcatcgggcaccaccagtacaccaacctggtatcggatcccgagttcgcgctgcctgagaacgacccggacgtcttcggcacctatccgctgatgcggatgcatccggacaccccttggaagccgcaccaccagctgcagcatatgtacgcgttcccgctgttcgccctgatgaccatcagcaaggtcatcatcagtgacttcacgttctgcctcgccaagcggcgcgggccgatcgacttctccgccaggctcgtgccacttgaggggcagatgctcttctggggcgcgaagatcatggggttcctgatgcagatagtcctgccgtgctatctgcatggcatcgcccatgggctggcgctgttcatcacagcccacctggtgtcgggagagtacctcgcggtctgcttcatcatcaaccacatctctgagtcatgcgactatttgaatccaagttccgtcatcgctgcgcggcggacggaaatgctgaagcaggcggagcaggaggccaaggcaaagcagaagcaccccaccccaccgcccaacgactgggccgcgtctcaggtactgtgctgcgtaaactggcgctctggtggatatttctcaaaccacctctcaggcgggctgaaccaccagatcgagcaccacctcttccccagcatctcacatgcgaactatccgaccattgccccagttgtgaaaggggtgtgcgaggagtacggcctcccctacaagaactactcccagttctctgacgctatctatggaatggtggagcacctcagggcgatgggcacgaagcccgaagacaacggcaagctggcgccactgccgggctccctggaggacgtgtgcccggtcctgagtgccgccgttgctgcccaacctgacggaagcaccgacggcagcgctgcgggttgtccagcagtagccacactggcataaagggcataatgagcaatgccatcatcactagacgacgttgctcaccttgttttccatttgtgccgtgccttgcggcccgtgttctgcatttgcgggcactagattcggtacccagccctcctcacagctctgcgatttgagccgtttgaggcaacgctccgctgacccttgtgcaggtcccccgaccatccgctccgaggagggcggtaaaacaaaacaaataacaacagcatgaggcgtcaatctctgcgatatgcggggcttgctccagctcacctggaccacttcgtccgctgcgcagctatagttttggggccgcagctaggtctgcggttacttcctttttttttctccggcgcagggcgcttggttctaagcctttcctccaatcctcgagccccctcgacctgaccgtgtcttcctctggctgaaagcggaggatgatttgtgcgttgctcagaaggaacctccatcggtggtggttttcgcatttcccattgatgtccaacagtgcttccattcagtttgaccaaaaaaaaaaaaaaaaaaaaaaaaaaaaaaaaaaaacccaacttt

SEQ ID NO: 102 - DNA, 10108 bp, Artificial Sequence
  plasmid pY168
cttgtacaaagtggtgatggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttagcaaaaagtgaaggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccagcggccatcacaagtttgtacaaaaaagttggattttttttcggtctccatggccgaaggcaagagcgatgggcctgtggtgacccttcaaagcatgtggaaaccgcttgctttgatggcagtagatgtcggcatattggtcaacgtccgccgcaaggctttcactgagtttgatgggcacagcaacgtttttgcagatcccgtttacattccatttgtgatgaatctcttctacttgaccatgatctttgctgggtgccgttggatgaagactcgcgaaccctttgagatcaagtcatatatgtttgcatacaatgcatatcagacgatgatgaacttcctcattgtcgtcgggttcatgtatgaggtgcacagcacagggatgcggtattgggggtccaggatcgacacctccaccaagggcttgggcctcggtttcctgatctatgcccactaccacaacaaatacgtggagtatgtcgacacgttgttcatgatcctgcgcaagaaaaacaaccagatctcgttcctccacgtctaccaccattcgcttttgacttgggcctggtgggccgtggtctactgggccccaggaggagatgcctggttcggagcatgctacaattcctttatccacgtgctgatgtactcctactacctgtttgcaacgtttggcatcaggtgcccctggaagaagatgctgacccagttgcagatggtgcaattctgcttctgctttgcccacgcgatgtatgttggatggctgggccatgaagtctacccgcgctggttgacggcgctacaggcatttgtgatgctaaacatgctggtgctgttcggcaacttctacatgaagtcgtactccaaggccagcaagctggagccggcctcccccgtgtcccccgcctccctcgcccagaagccgttcgagaacgccaaggtgaagcctgggggccccggcaagccaagcgagattgcgtcgctgccaccgccaattcgaccagtcgggaacccacctgcagcctactacgatgccctggcgacctcgggcaccgggcaggaccgcaagttcaccatgcgggaggtggcccgccatattgtgccgaccgatgggtggttggcgtgccatgacggtgtctacgacatcaccgagttcatagggaaacatcctggcggcgatgttatttctctcggattgggcagggactccacaatcctggttgagtcgtaccaccctgccggaaggccagacaaggtcatggaaaagtaccgcatcgggacgctccaggaccaccgcacgttctacgactggcaggcctccgcgttctacgccgagctgaagcagcgggtggtgcagacgctaaaggaggccggccaaccgcggcgtgggggcctgtcggtcaaagcggcgctggtcatggcggcgttcgcagcgtcgttctacctcatggtgacccagggatccttcttctgggccgccgtctggggcctcgccggctcccacattggcctcagcatccagcacgacgggaaccacggggctttcagtaagagtggtcggctgaaccgcctcgcgggctggggcatggacgtcatcggggcctcctcgacggcctgggagtaccagcacgtcatcgggcaccaccagtacaccaacctggtatcggatcccgagttcgcgctgcctgagaacgacccggacgtcttcggcacctatccgctgatgcggatgcatccggacaccccttggaagccgcaccaccagctgcagcatatgtacgcgttcccgctgttcgccctgatgaccatcagcaaggtcatcatcagcgacttcacgttctgcctcgccaagcggcgcgggccgatcgacttctccgccaggctcgtgccacttgaggggcagatgctcttctggggggcgaagatcatggggttcctgatgcagatagtcctgccgtgctatctgcatggcatcgcccatgggctggcgctgttcatcacagcccacctggtgtcgggagagtacctcgcggtctgcttcatcatcaaccacatctctgagtcatgcgactatttgaatccaagttccgtcatcgctgcgcggcggacggaaatgctgaagcaggcggagcaggaggccaaggcaaagcagaagcaccccaccccaccgcccaacgactgggccgcgtctcaggtactgtgctgcgtaaactggcgctctggtggatatttctcaaaccacctctcaggcgggctgaaccaccagatcgagcaccacctcttccccagcatctcacatgcgaactatccgaccattgccccagttgtgaaaagggtgtgcgaggagtacggcctcccctacaagaactactcccagttctctgacctctctatggaatggtggagcacctcagggcgatgggcacgaagccggcagacaacgacaagctggcgccaccactgggctccctggaggacgtgtgcccggtcctgagtgccgccgttgctgcccaacctgacggaagcaccgacggcagcgctgcaggttgtccagcagtagccacactggcataaagggcataatgagcatgccatcatcactagacgacgttgctcaccttgttttccatttgtgccgtgccttgcggcccgtgttctgcatttgcgggcactagattcggtacccagccctcctcacagctctgcgatttgagccgtttgaggcaacgctccgctgacccttgtgcaggtcccccgaccatccgctccgaggagggcggtaaaacaaaacaaataacaacagcatgaggcgtcaatctctgcgatatgcggggcttgctccagctcacctggaccacttcgtccgctgcgcagctatagttttggggccgcagctaggtctgcggttacttccttttttttttctccggcgcagggcgcttggttctaagcctttcctccaatcctcgagccccctcgacctgaccgtgtcttcctctggctgaaagcggaggatgatttgtgcgttgctcagaaggaacctccatcggtggtggttttcgcatttcccaaaaaaaaaaaaaaaaaaaaacccaacttt

SEQ ID NO: 103 - DNA, 24 bp, Artificial Sequence
  primer oEGel2-1
agcggccgcacaatggcggatagc

SEQ ID NO: 104 - DNA, 5916 bp, Artificial Sequence
  plasmid pKR1055
aattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaagcccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgtatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgccagtgtgatggatatctgcagaattcaggagcggccgcacaatggcggatagcccagtcatcaacctcagcaccatgtggaaacccctttcactgatggctttggaccttgccgttttgggacatgtctggaagcaggcacaacaggagggcagcatttcggcctatgctgattctgtttggactcctctcattatgtccggtttatacttatcaatgatcttcgtggggtgccgctggatgaagaaccgtgaaccctttgagatcaaaacatacatgtttgcgtataacctgtatcagaccttgatgaacctttgcatcgtgttgggattcttgtaccaggtgcatgccactgggatgcgcttttggggaagtggtgtcgaccgaagcccaaaaggtttgggcattggcttcttcatttatgcccactaccacaacaagtatgtggaatattttgatacactttttatggtgctgcgaaagaagaacaaccagatttctttccttcacgtgtatcatcatgccctgttgacatgggcttggtttgctgttgtgtatttcgcacctggaggtgatggctggtttggagcttgctacaattcttccatccatgtcctgatgtactcttactacttgcttgcaacttttggcatcagttgcccatggaagaagatcttgacacagctccagatggttcaattctgtttctgttttacacattccatttatgtgtggatttgcgggtcagagatctacccacggcctctgactgctttgcagtcgttcgtgatggtcaatatgttggtgctgtttggcaatttctatgtcaagcaatactcccaaaagaacggcaagccggagaacggagccacccctgagaacggagcgaagccgcaaccttgcgagaacggcacggtggaaaagcgagagaatgacaccgccaacgttcggcccgcccgtccagctggactcccgccggccacgtactacgactccctggcagtgtcggggcagggcaaggagcggctgttcaccaccgatgaggtgaggcggcacatcctccccaccgatggctggctgacgtgccacgaaggagtctacgatgtcactgatttccttgccaagcaccctggtggcggtgtcatcacgctgggccttggaagggactgcacaatcctcgtcgagtcataccaccctgctgggcgcccggacaaggtgatggagaagtaccgcattggtacgctgcaggaccccaagacgttctatgcttggggagagtccgatttctaccctgagttgaagcgccgggcccttgcaaggctgaaggaggctggtcaggcgcggcgcggcggccttggggtgaaggccctcctggtgctcaccctcttcttcgtgtcgtggtacatgtgggtggcccacaagtccttcctctgggccgccgtctggggcttcgccggctcccacgtcgggctgagcatccagcacgacggcaaccacggcgcgttcagccgcagcacactggtgaaccgcctggcggggtggggcatggacttgatcggcgcgtcgtcaacggtgtgggagtaccagcacgtcatcggccaccaccagtacaccaacctcgtgtcggacacgctattcagtctgcctgagaacgatccggacgtcttctccagctacccgctgatgcgcatgcacccggatacggcgtggcagccgcaccaccgcttccagcacctgttcgcgttcccactgttcgccctgatgacaatcagcaaggtgctgaccagcgatttcgctgtctgcctcagcatgaagaaggggtccatcgactgctcctccaggctcgtcccactggaggggcagctgctgttctggggggccaagctggcgaacttcctgttgcagattgtgttgccatgctacctccacgggacagctatgggcctggccctcttctctgttgcccaccttgtgtcgggggagtacctcgcgatctgcttcatcatcaaccacatcagcgagtcttgtgagtttatgaatacaagctttcaaaccgccgcccggaggacagagatgcttcaggcagcccatcaggcagcggaggccaagaaggtgaagcccacccctccaccgaacgattgggctgtgacacaggtccaatgctgcgtgaattggagatcaggtggcgtgttggccaatcacctctctggaggcttgaaccaccagatcgagcatcatctgttccccagcatctcgcatgccaactaccccatcatcgcccgtgttgtgaaggaggtgtgcgaggagtatgggttgccgtacaagaactacgtcacgttctgggatgcagtctgtggcatggttcagcacctccggttgatgggtgctccaccggtgccaacgaacggggacaaaaagtcataagcggccgcacctg

SEQ ID NO: 105 - DNA, 7085 bp, Artificial Sequence
  plasmid pKR72
gtacggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatcgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttgttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaatttcatatagtgttaaataataatttgttaaataaccaaaaagtcaaatatgtttactctcgtttaaataattgagattcgtccagcaaggctaaacgattgtatagatttatgacaatatttacttttttatagataaatgttatattataataaatttatatacatatattatatgttatttattattattttaaatccttcaatattttatcaaaccaactcataattttttttttatctgtaagaagcaataaaattaaatagacccactttaaggatgatccaacctttatacagagtaagagagttcaaatagtaccctttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaggttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatacttgcggccgcagtatatcttaaattctttaatacggtgtactaggatattgaactggttcttgatgatgaaaacctgggccgagattgcagctatttatagtcataggtcttgttaacatgcatggacatttggccacggggtggcatgcagtttgacgggtgttgaaataaacaaaaatgaggtggcggaagagaatacgagtttgaggttgggttagaaacaacaaatgtgagggctcatgatgggttgagttggtgaatgttttgggctgctcgattgacacctttgtgagtacgtgttgttgtgcatggcttttggggtccagtttttttttcttgacgcggcgatcctgatcagctagtggataagtgatgtccactgtgtgtgattgcgtttttgtttgaattttatgaacttagacattgctatgcaaaggatactctcattgtgttttgtcttcttttgttccttggctttttcttatgatccaagagactagtcagtgttgtggcattcgagactaccaagattaattatgatgggggaaggataagtaactgattagtacggactgttaccaaattaattaataagcggcaaatgaagggcatggatcaaaagcttggatctcctgcaggatctggccggccggatctc

SEQ ID NO: 106 - DNA, 32 bp, Artificial Sequence
  primer oCon-1
aatctagacctgcaggatccatgcccttcatt

SEQ ID NO: 107 - DNA, 33 bp, Artificial Sequence
  primer oCon-2
tttctagacctgcaggttgaaacatccctgaag

SEQ ID NO: 108 - DNA, 4480 bp, Artificial Sequence
  plasmid pKR179
ctagacctgcaggatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacctgcaggtctagaggatccccgggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgact

SEQ ID NO: 109 - DNA, 6873 bp, Artificial Sequence
  plasmid pKR1057
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacctgcaggtctagaggatccccgggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactctagacctgcaggatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcacaatggcggatagcccagtcatcaacctcagcaccatgtggaaacccctttcactgatggctttggaccttgccgttttgggacatgtctggaagcaggcacaacaggagggcagcatttcggcctatgctgattctgtttggactcctctcattatgtccggtttatacttatcaatgatcttcgtggggtgccgctggatgaagaaccgtgaaccctttgagatcaaaacatacatgtttgcgtataacctgtatcagaccttgatgaacctttgcatcgtgttgggattcttgtaccaggtgcatgccactgggatgcgcttttggggaagtggtgtcgaccgaagcccaaaaggtttgggcattggcttcttcatttatgcccactaccacaacaagtatgtggaatattttgatacactttttatggtgctgcgaaagaagaacaaccagatttctttccttcacgtgtatcatcatgccctgttgacatgggcttggtttgctgttgtgtatttcgcacctggaggtgatggctggtttggagcttgctacaattcttccatccatgtcctgatgtactcttactacttgcttgcaacttttggcatcagttgcccatggaagaagatcttgacacagctccagatggttcaattctgtttctgttttacacattccatttatgtgtggatttgcgggtcagagatctacccacggcctctgactgctttgcagtcgttcgtgatggtcaatatgttggtgctgtttggcaatttctatgtcaagcaatactcccaaaagaacggcaagccggagaacggagccacccctgagaacggagcgaagccgcaaccttgcgagaacggcacggtggaaaagcgagagaatgacaccgccaacgttcggcccgcccgtccagctggactcccgccggccacgtactacgactccctggcagtgtcggggcagggcaaggagcggctgttcaccaccgatgaggtgaggcggcacatcctccccaccgatggctggctgacgtgccacgaaggagtctacgatgtcactgatttccttgccaagcaccctggtggcggtgtcatcacgctgggccttggaagggactgcacaatcctcgtcgagtcataccaccctgctgggcgcccggacaaggtgatggagaagtaccgcattggtacgctgcaggaccccaagacgttctatgcttggggagagtccgatttctaccctgagttgaagcgccgggcccttgcaaggctgaaggaggctggtcaggcgcggcgcggcggccttggggtgaaggccctcctggtgctcaccctcttcttcgtgtcgtggtacatgtgggtggcccacaagtccttcctctgggccgccgtctggggcttcgccggctcccacgtcgggctgagcatccagcacgacggcaaccacggcgcgttcagccgcagcacactggtgaaccgcctggcggggtggggcatggacttgatcggcgcgtcgtcaacggtgtgggagtaccagcacgtcatcggccaccaccagtacaccaacctcgtgtcggacacgctattcagtctgcctgagaacgatccggacgtcttctccagctacccgctgatgcgcatgcacccggatacggcgtggcagccgcaccaccgcttccagcacctgttcgcgttcccactgttcgccctgatgacaatcagcaaggtgctgaccagcgatttcgctgtctgcctcagcatgaagaaggggtccatcgactgctcctccaggctcgtcccactggaggggcagctgctgttctggggggccaagctggcgaacttcctgttgcagattgtgttgccatgctacctccacgggacagctatgggcctggccctcttctctgttgcccaccttgtgtcgggggagtacctcgcgatctgcttcatcatcaaccacatcagcgagtcttgtgagtttatgaatacaagctttcaaaccgccgcccggaggacagagatgcttcaggcagcccatcaggcagcggaggccaagaaggtgaagcccacccctccaccgaacgattgggctgtgacacaggtccaatgctgcgtgaattggagatcaggtggcgtgttggccaatcacctctctggaggcttgaaccaccagatcgagcatcatctgttccccagcatctcgcatgccaactaccccatcatcgcccgtgttgtgaaggaggtgtgcgaggagtatgggttgccgtacaagaactacgtcacgttctgggatgcagtctgtggcatggttcagcacctccggttgatgggtgctccaccggtgccaacgaacggggacaaaaagtcataagc

SEQ ID NO: 110 - DNA, 8671 bp, Artificial Sequence
  plasmid pKR328
ggatctggccggccggatctcgtacggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatcgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttggatctcctgcagcccgggggatccgcccacgtacggtaccatctgctaatattttaaatcacatgcaagagaggaggcatggttccattttctaccttcacattatttgagaaaaacgaacttgttctgtgttttatttttgcccttcacattagtacaacgtggaagactcatggttacacagaatcatacataagtacaatgcttgtccctaagaaaacaagcactcgttgtattgaacctttacggctcatgcggccgcgaattcactagtgattgaattcgcggccgcttagtccgacttggccttggcggccgcggccgactctttgagcgtgaagatctgcgccgtctcgggcacagcgccgtagttgacaaagaggtgcgcggtcttgaagaaggccgtgatgatgggctcgtcgttcctgcgcacgaggtgcgggtacgcggccgcaaagtgcttggtggcttcgttgagcttgtagtgcggaatgatcgggaacaagtggtggacctggtgcgtgccaatgtggtggctcaggttgtccacgaacgcgccgtacgagcggtcgacgctcgagaggttgcccttgacgtacgtccactccgagtcgccgtaccacggcgtcgcttcgtcgttgtggtgcaagaaggtcgtaatgacgaggaacgaagcaaagacaaagagcggcgcatagtagtagaggcccatgacggcaaagccgagcgagtatgtgaggtacgcgtacgcggcgaagaaggcggcccagacgccgagcgacacgatgacggccgacgcgcggcgaaggaggagcgggtcccacgggtcaaagtggctcatcgtgcgcggggcatacccgaccttcaagtagacaaaccacgcaccgccgagcgtgtagacccattggcgcacgtcctggaggtccttgaccgaccggtgcgggtaaaagatctcgtccttatcaatgttgcccgtgttcttgtggtggtggcggtgcgtcacgcgccagctctcgaacggcgtcaaaatcgcagagtgcatgatgcagccgatgataaagttgacgctgtggtagcgcgagaaggccgagtggccgcagtcgtggccgaccgtgaagaagccccagaagatgacgccctgcacgtagatgtaggtggcgcaaacgagcgcgtggagcagaacgttatcggcaatgaacggcgtcgagcgcgccgcgtagagcagcgccgccgaggccgacgcgttgaagatcgcgcgggccgtgtagtagagcgagaggccgaggttcgactcaaagcacgcgttcgggatcgagtgcttgagctccgtgagcgtcgggaactcgaccttcgtcttatcctcagtcatgcggccgctgaagtattgcttcttagttaacctttcctttctctctcagctatgtgaattcattttgctttcgtcacaatttatatagtgaaattggatctttggagttaacgccttcacaggattatcgtgttagaacaatgctttttcatgttctaattagtagtacattacaaatgtgcactctattcaataagcatcttttggcacgttaataaatcatgtgaaaaaaaaatactactatttcaaagaaagtgttgtaaaaagaaacggaaagagagctggcttcagttgttgagacttgtttgctagtaaaaatggtgtgaagagtgattcatggtgaggtggtttttcgtccctttctgtttgcatgaaaaacaaatggcaagagatgacgtaggattccttcccttaacgattatctgtttttaatttcaaatatacatataggaatttatgaattactaaggttgtaaaatatgctggtcatttatttatggctaaaatatttttttttctcgtaaatataaaaatatttaaaatttatttttatcatattttttatccttataaaattatgtgtacaacctatataaaaaaatatcatatttaatattgattatatgtttaatcaatataaaaaatcattatcatatatttagatttattcgaatatacatctaaacaaaaaataacatattttaattttatgaagaaaaaaaaatattttatcctttatttatttaagattaattaatagttatgtattgtggaaagacttttacacatgcaatagatatactgaatcaattagatgccaatgctgagttggaaatcacttgaggaggggaggagacttgccaatgcttttcagtttcatttaaatgatttagtggaggagatagagtagtgataaaggcatgccccaattttggagtgtatatatgagtggaaataagagagggatagagagaaaaaataaagagagtaaaaataattaatgtgaaatgatatgataaaaaaataaagaaagagataaagagaaaaatgaaatgagagatagatgaaatagagagtagatacatgtttgtttaggttttttttaggaaataacacatttttttctcatcacttattactcactgtcaatttcctctctttcaatcataatgatatgatttgtttaacaaaaatgtgaaaaaacatataaagtaaaatatttttataaattgataaataaaaatttacaaaatttatttcttattaaattgaatagaaaatgaaagaaaagaaaagaaaaagtatatataaaatgatatagctttaaaaagaataaatttttcatatcagtctttttttaataatttagaaatatttaagtatatagcaaaaatataatgtactttacatatgcataaataataatttgaaaatagaactaatagaatagagaaaaaagtaatataataattaactatatgaaaatttagaagggacaatatttttaattaagaatataaacaatatttcttttcatgtaatgagggacggatgtacggggccagtgttggagtcaaagccaaaatagtcacggggaaattaatgcactgcatgactattcgaaaaaattcactagccttacttagatgttagattaatagctagggggtgcagataattttgaaaggcatgaaaaacattaatttgtacattgcaagcttttgatgacaagctttgcaattgttcacactaccttatgccatttataaatagagtgattggcatatgaaggaaatcatgagagtcgaagcgaaaaacaaagcttgagagtgtaggaaaaatacagtttttttggtaaaaatacagtatttgaataggagcgaaaaatatcctttcaaaatgatccttttctttttttttttttttcttgttgttcttggtcagttattcaaaggaaaagggattgaaataaaaacttgcatgtgggatcgtacgtcgagtcgacctgca

SEQ ID NO: 111 - DNA, 12844 bp, Artificial Sequence
  plasmid pKR1061
ggatctggccggccggatctcgtacggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatcgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttggatctcctgcagcccgggggatccgcccacgtacggtaccatctgctaatattttaaatcacatgcaagagaggaggcatggttccattttctaccttcacattatttgagaaaaacgaacttgttctgtgttttatttttgcccttcacattagtacaacgtggaagactcatggttacacagaatcatacataagtacaatgcttgtccctaagaaaacaagcactcgttgtattgaacctttacggctcatgcggccgcgaattcactagtgattgaattcgcggccgcttagtccgacttggccttggcggccgcggccgactctttgagcgtgaagatctgcgccgtctcgggcacagcgccgtagttgacaaagaggtgcgcggtcttgaagaaggccgtgatgatgggctcgtcgttcctgcgcacgaggtgcgggtacgcggccgcaaagtgcttggtggcttcgttgagcttgtagtgcggaatgatcgggaacaagtggtggacctggtgcgtgccaatgtggtggctcaggttgtccacgaacgcgccgtacgagcggtcgacgctcgagaggttgcccttgacgtacgtccactccgagtcgccgtaccacggcgtcgcttcgtcgttgtggtgcaagaaggtcgtaatgacgaggaacgaagcaaagacaaagagcggcgcatagtagtagaggcccatgacggcaaagccgagcgagtatgtgaggtacgcgtacgcggcgaagaaggcggcccagacgccgagcgacacgatgacggccgacgcgcggcgaaggaggagcgggtcccacgggtcaaagtggctcatcgtgcgcggggcatacccgaccttcaagtagacaaaccacgcaccgccgagcgtgtagacccattggcgcacgtcctggaggtccttgaccgaccggtgcgggtaaaagatctcgtccttatcaatgttgcccgtgttcttgtggtggtggcggtgcgtcacgcgccagctctcgaacggcgtcaaaatcgcagagtgcatgatgcagccgatgataaagttgacgctgtggtagcgcgagaaggccgagtggccgcagtcgtggccgaccgtgaagaagccccagaagatgacgccctgcacgtagatgtaggtggcgcaaacgagcgcgtggagcagaacgttatcggcaatgaacggcgtcgagcgcgccgcgtagagcagcgccgccgaggccgacgcgttgaagatcgcgcgggccgtgtagtagagcgagaggccgaggttcgactcaaagcacgcgttcgggatcgagtgcttgagctccgtgagcgtcgggaactcgaccttcgtcttatcctcagtcatgcggccgctgaagtattgcttcttagttaacctttcctttctctctcagctatgtgaattcattttgctttcgtcacaatttatatagtgaaattggatctttggagttaacgccttcacaggattatcgtgttagaacaatgctttttcatgttctaattagtagtacattacaaatgtgcactctattcaataagcatcttttggcacgttaataaatcatgtgaaaaaaaaatactactatttcaaagaaagtgttgtaaaaagaaacggaaagagagctggcttcagttgttgagacttgtttgctagtaaaaatggtgtgaagagtgattcatggtgaggtggtttttcgtccctttctgtttgcatgaaaaacaaatggcaagagatgacgtaggattccttcccttaacgattatctgtttttaatttcaaatatacatataggaatttatgaattactaaggttgtaaaatatgctggtcatttatttatggctaaaatatttttttttctcgtaaatataaaaatatttaaaatttatttttatcatattttttatccttataaaattatgtgtacaacctatataaaaaaatatcatatttaatattgattatatgtttaatcaatataaaaaatcattatcatatatttagatttattcgaatatacatctaaacaaaaaataacatattttaattttatgaagaaaaaaaaatattttatcctttatttatttaagattaattaatagttatgtattgtggaaagacttttacacatgcaatagatatactgaatcaattagatgccaatgctgagttggaaatcacttgaggaggggaggagacttgccaatgcttttcagtttcatttaaatgatttagtggaggagatagagtagtgataaaggcatgccccaattttggagtgtatatatgagtggaaataagagagggatagagagaaaaaataaagagagtaaaaataattaatgtgaaatgatatgataaaaaaataaagaaagagataaagagaaaaatgaaatgagagatagatgaaatagagagtagatacatgtttgtttaggttttttttaggaaataacacatttttttctcatcacttattactcactgtcaatttcctctctttcaatcataatgatatgatttgtttaacaaaaatgtgaaaaaacatataaagtaaaatatttttataaattgataaataaaaatttacaaaatttatttcttattaaattgaatagaaaatgaaagaaaagaaaagaaaaagtatatataaaatgatatagctttaaaaagaataaatttttcatatcagtctttttttaataatttagaaatatttaagtatatagcaaaaatataatgtactttacatatgcataaataataatttgaaaatagaactaatagaatagagaaaaaagtaatataataattaactatatgaaaatttagaagggacaatatttttaattaagaatataaacaatatttcttttcatgtaatgagggacggatgtacggggccagtgttggagtcaaagccaaaatagtcacggggaaattaatgcactgcatgactattcgaaaaaattcactagccttacttagatgttagattaatagctagggggtgcagataattttgaaaggcatgaaaaacattaatttgtacattgcaagcttttgatgacaagctttgcaattgttcacactaccttatgccatttataaatagagtgattggcatatgaaggaaatcatgagagtcgaagcgaaaaacaaagcttgagagtgtaggaaaaatacagtttttttggtaaaaatacagtatttgaataggagcgaaaaatatcctttcaaaatgatccttttctttttttttttttttcttgttgttcttggtcagttattcaaaggaaaagggattgaaataaaaacttgcatgtgggatcgtacgtcgagtcgacctgcaggatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcacaatggcggatagcccagtcatcaacctcagcaccatgtggaaacccctttcactgatggctttggaccttgccgttttgggacatgtctggaagcaggcacaacaggagggcagcatttcggcctatgctgattctgtttggactcctctcattatgtccggtttatacttatcaatgatcttcgtggggtgccgctggatgaagaaccgtgaaccctttgagatcaaaacatacatgtttgcgtataacctgtatcagaccttgatgaacctttgcatcgtgttgggattcttgtaccaggtgcatgccactgggatgcgcttttggggaagtggtgtcgaccgaagcccaaaaggtttgggcattggcttcttcatttatgcccactaccacaacaagtatgtggaatattttgatacactttttatggtgctgcgaaagaagaacaaccagatttctttccttcacgtgtatcatcatgccctgttgacatgggcttggtttgctgttgtgtatttcgcacctggaggtgatggctggtttggagcttgctacaattcttccatccatgtcctgatgtactcttactacttgcttgcaacttttggcatcagttgcccatggaagaagatcttgacacagctccagatggttcaattctgtttctgttttacacattccatttatgtgtggatttgcgggtcagagatctacccacggcctctgactgctttgcagtcgttcgtgatggtcaatatgttggtgctgtttggcaatttctatgtcaagcaatactcccaaaagaacggcaagccggagaacggagccacccctgagaacggagcgaagccgcaaccttgcgagaacggcacggtggaaaagcgagagaatgacaccgccaacgttcggcccgcccgtccagctggactcccgccggccacgtactacgactccctggcagtgtcggggcagggcaaggagcggctgttcaccaccgatgaggtgaggcggcacatcctccccaccgatggctggctgacgtgccacgaaggagtctacgatgtcactgatttccttgccaagcaccctggtggcggtgtcatcacgctgggccttggaagggactgcacaatcctcgtcgagtcataccaccctgctgggcgcccggacaaggtgatggagaagtaccgcattggtacgctgcaggaccccaagacgttctatgcttggggagagtccgatttctaccctgagttgaagcgccgggcccttgcaaggctgaaggaggctggtcaggcgcggcgcggcggccttggggtgaaggccctcctggtgctcaccctcttcttcgtgtcgtggtacatgtgggtggcccacaagtccttcctctgggccgccgtctggggcttcgccggctcccacgtcgggctgagcatccagcacgacggcaaccacggcgcgttcagccgcagcacactggtgaaccgcctggcggggtggggcatggacttgatcggcgcgtcgtcaacggtgtgggagtaccagcacgtcatcggccaccaccagtacaccaacctcgtgtcggacacgctattcagtctgcctgagaacgatccggacgtcttctccagctacccgctgatgcgcatgcacccggatacggcgtggcagccgcaccaccgcttccagcacctgttcgcgttcccactgttcgccctgatgacaatcagcaaggtgctgaccagcgatttcgctgtctgcctcagcatgaagaaggggtccatcgactgctcctccaggctcgtcccactggaggggcagctgctgttctggggggccaagctggcgaacttcctgttgcagattgtgttgccatgctacctccacgggacagctatgggcctggccctcttctctgttgcccaccttgtgtcgggggagtacctcgcgatctgcttcatcatcaaccacatcagcgagtcttgtgagtttatgaatacaagctttcaaaccgccgcccggaggacagagatgcttcaggcagcccatcaggcagcggaggccaagaaggtgaagcccacccctccaccgaacgattgggctgtgacacaggtccaatgctgcgtgaattggagatcaggtggcgtgttggccaatcacctctctggaggcttgaaccaccagatcgagcatcatctgttccccagcatctcgcatgccaactaccccatcatcgcccgtgttgtgaaggaggtgtgcgaggagtatgggttgccgtacaagaactacgtcacgttctgggatgcagtctgtggcatggttcagcacctccggttgatgggtgctccaccggtgccaacgaacggggacaaaaagtcataagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacctgca

SEQ ID NO: 112 - DNA, 777 bp, Euglena gracilis
  misc_feature (1)..(777): delta-9 elongase
  ref <302>: TITLE: DELTA-9 ELONGASES AND THEIR USE IN MAKING POLYUNSATURATED FATTY ACIDS
  ref <310>: PATENT DOCUMENT NUMBER: US-2007-0118929-A1
  ref <311>: PATENT FILING DATE: 2006-11-16
  ref <312>: PUBLICATION DATE: 2007-05-24
  ref <313>: RELEVANT RESIDUES IN SEQ ID NO: (1)..(777)
  ref <302>: TITLE: DELTA-9 ELONGASES AND THEIR USE IN MAKING POLYUNSATURATED FATTY ACIDS
  ref <310>: PATENT DOCUMENT NUMBER: WO 2007/061845
  ref <311>: PATENT FILING DATE: 2006-11-16
  ref <312>: PUBLICATION DATE: 2007-05-31
  ref <313>: RELEVANT RESIDUES IN SEQ ID NO: (1)..(777)
atggaggtggtgaatgaaatagtctcaattgggcaggaagttttacccaaagttgattatgcccaactctggagtgatgccagtcactgtgaggtgctttacttgtccatcgcatttgtcatcttgaagttcactcttggcccccttggtccaaaaggtcagtctcgtatgaagtttgttttcaccaattacaaccttctcatgtccatttattcgttgggatcattcctctcaatggcatatgccatgtacaccatcggtgttatgtctgacaactgcgagaaggcttttgacaacaacgtcttcaggatcaccacgcagttgttctatttgagcaagttcctggagtatattgactccttctatttgccactgatgggcaagcctctgacctggttgcaattcttccatcatttgggggcaccgatggatatgtggctgttctataattaccgaaatgaagctgtttggatttttgtgctgttgaatggtttcatccactggatcatgtacggttattattggaccagattgatcaagctgaagttccccatgccaaaatccctgattacatcaatgcagatcattcaattcaatgttggtttctacattgtctggaagtacaggaacattccctgttatcgccaagatgggatgaggatgtttggctggttcttcaattacttttatgttggcacagtcttgtgtttgttcttgaatttctatgtgcaaacgtatatcgtcaggaagcacaagggagccaaaaagattcagtga

SEQ ID NO: 113 - DNA, 30 bp, Artificial Sequence
  primer oEugEL1-1
agcggccgcaccatggaggtggtgaatgaa

SEQ ID NO: 114 - DNA, 30 bp, Artificial Sequence
  primer oEugEL1-2
tgcggccgctcactgaatctttttggctcc

SEQ ID NO: 115 - DNA, 4311 bp, Artificial Sequence
  plasmid pKR906
agcggccgcaccatggaggtggtgaatgaaatagtctcaattgggcaggaagttttacccaaagttgattatgcccaactctggagtgatgccagtcactgtgaggtgctttacttgtccatcgcatttgtcatcttgaagttcactcttggcccccttggtccaaaaggtcagtctcgtatgaagtttgttttcaccaattacaaccttctcatgtccatttattcgttgggatcattcctctcaatggcatatgccatgtacaccatcggtgttatgtctgacaactgcgagaaggcttttgacaacaacgtcttcaggatcaccacgcagttgttctatttgagcaagttcctggagtatattgactccttctatttgccactgatgggcaagcctctgacctggttgcaattcttccatcatttgggggcaccgatggatatgtggctgttctataattaccgaaatgaagctgtttggatttttgtgctgttgaatggtttcatccactggatcatgtacggttattattggaccagattgatcaagctgaagttccccatgccaaaatccctgattacatcaatgcagatcattcaattcaatgttggtttctacattgtctggaagtacaggaacattccctgttatcgccaagatgggatgaggatgtttggctggttcttcaattacttttatgttggcacagtcttgtgtttgttcttgaatttctatgtgcaaacgtatatcgtcaggaagcacaagggagccaaaaagattcagtgagcggccgcacctgaattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaagcccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgtatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgccagtgtgatggatatctgcagaattcagg

SEQ ID NO: 116 - DNA, 3983 bp, Artificial Sequence
  plasmid pKR132
ctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccggggatcctctagacctgcaggccaactgcgtttggggctccagattaaacgacgccgtttcgttcctttcgcttcacggcttaacgatgtcgtttctgtctgtgcccaaaaaataaaggcatttgttatttgcaccagatatttactaagtgcaccctagtttgacaagtaggcgataattacaaatagatgcggtgcaaataataaattttgaaggaaataattacaaaagaacagaacttatatttactttattttaaaaaactaaaatgaaagaacaaaaaaagtaaaaaatacaaaaaatgtgctttaaccactttcattatttgttacagaaagtatgattctactcaaattgatctgttgtatctggtgctgccttgtcacactggcgatttcaatcccctaaagatatggtgcaaactgcgaagtgatcaatatctgctcggttaatttagattaattaataatattcaacgtgatgtaccaaaaaaagacaattttttgctccattgacaaattaaacctcatcaaggtaatttccaaacctataagcaaaaaaatttcacattaattggcccgcaatcctattagtcttattatactagagtaggaaaaaaaacaattacacaacttgtcttattattctctatgctaatgaatatttttcccttttgttagaaatcagtgtttcctaatttattgagtattaattccactcaccgcatatatttaccgttgaataagaaaattttacacataattctttttaagataaataatttttttatactagatcttatatgattacgtgaagccaagtgggttatactaatgatatataatgtttgatagtaatcagtttataaaccaaatgcatggaaatgttacgtggaagcacgtaaattaacaagcattgaagcaaatgcagccaccgcaccaaaaccaccccacttcacttccacgtaccatattccatgcaactacaacaccctaaaacttcaataaatgcccccaccttcacttcacttcacccatcaatagcaagcggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgcgtacgt

SEQ ID NO: 117 - DNA, 4771 bp, Artificial Sequence
  plasmid pKR953
ggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgcgtacgtctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccggggatcctctagacctgcaggccaactgcgtttggggctccagattaaacgacgccgtttcgttcctttcgcttcacggcttaacgatgtcgtttctgtctgtgcccaaaaaataaaggcatttgttatttgcaccagatatttactaagtgcaccctagtttgacaagtaggcgataattacaaatagatgcggtgcaaataataaattttgaaggaaataattacaaaagaacagaacttatatttactttattttaaaaaactaaaatgaaagaacaaaaaaagtaaaaaatacaaaaaatgtgctttaaccactttcattatttgttacagaaagtatgattctactcaaattgatctgttgtatctggtgctgccttgtcacactggcgatttcaatcccctaaagatatggtgcaaactgcgaagtgatcaatatctgctcggttaatttagattaattaataatattcaacgtgatgtaccaaaaaaagacaattttttgctccattgacaaattaaacctcatcaaggtaatttccaaacctataagcaaaaaaatttcacattaattggcccgcaatcctattagtcttattatactagagtaggaaaaaaaacaattacacaacttgtcttattattctctatgctaatgaatatttttcccttttgttagaaatcagtgtttcctaatttattgagtattaattccactcaccgcatatatttaccgttgaataagaaaattttacacataattctttttaagataaataatttttttatactagatcttatatgattacgtgaagccaagtgggttatactaatgatatataatgtttgatagtaatcagtttataaaccaaatgcatggaaatgttacgtggaagcacgtaaattaacaagcattgaagcaaatgcagccaccgcaccaaaaccaccccacttcacttccacgtaccatattccatgcaactacaacaccctaaaacttcaataaatgcccccaccttcacttcacttcacccatcaatagcaagcggccgcaccatggaggtggtgaatgaaatagtctcaattgggcaggaagttttacccaaagttgattatgcccaactctggagtgatgccagtcactgtgaggtgctttacttgtccatcgcatttgtcatcttgaagttcactcttggcccccttggtccaaaaggtcagtctcgtatgaagtttgttttcaccaattacaaccttctcatgtccatttattcgttgggatcattcctctcaatggcatatgccatgtacaccatcggtgttatgtctgacaactgcgagaaggcttttgacaacaacgtcttcaggatcaccacgcagttgttctatttgagcaagttcctggagtatattgactccttctatttgccactgatgggcaagcctctgacctggttgcaattcttccatcatttgggggcaccgatggatatgtggctgttctataattaccgaaatgaagctgtttggatttttgtgctgttgaatggtttcatccactggatcatgtacggttattattggaccagattgatcaagctgaagttccccatgccaaaatccctgattacatcaatgcagatcattcaattcaatgttggtttctacattgtctggaagtacaggaacattccctgttatcgccaagatgggatgaggatgtttggctggttcttcaattacttttatgttggcacagtcttgtgtttgttcttgaatttctatgtgcaaacgtatatcgtcaggaagcacaagggagccaaaaagattcagtgagc

SEQ ID NO: 118 - DNA, 5492 bp, Artificial Sequence
  plasmid pKR287
ggccgcatttcgcaccaaatcaatgaaagtaataatgaaaagtctgaataagaatacttaggcttagatgcctttgttacttgtgtaaaataacttgagtcatgtacctttggcggaaacagaataaataaaaggtgaaattccaatgctctatgtataagttagtaatacttaatgtgttctacggttgtttcaatatcatcaaactctaattgaaactttagaaccacaaatctcaatcttttcttaatgaaatgaaaaatcttaattgtaccatgtttatgttaaacaccttacaattggttggagaggaggaccaaccgatgggacaacattgggagaaagagattcaatggagatttggataggagaacaacattctttttcacttcaatacaagatgagtgcaacactaaggatatgtatgagactttcagaagctacgacaacatagatgagtgaggtggtgattcctagcaagaaagacattagaggaagccaaaatcgaacaaggaagacatcaagggcaagagacaggaccatccatctcaggaaaaggagctttgggatagtccgagaagttgtacaagaaattttttggagggtgagtgatgcattgctggtgactttaactcaatcaaaattgagaaagaaagaaaagggagggggctcacatgtgaatagaagggaaacgggagaattttacagttttgatctaatgggcatcccagctagtggtaacatattcaccatgtttaaccttcacgtacgtctagaggatccccgggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgcggccgcatgggaacggaccaaggaaaaaccttcacctgggaagagctggcggcccataacaccaaggacgacctactcttggccatccgcggcagggtgtacgatgtcacaaagttcttgagccgccatcctggtggagtggacactctcctgctcggagctggccgagatgttactccggtctttgagatgtatcacgcgtttggggctgcagatgccattatgaagaagtactatgtcggtacactggtctcgaatgagctgcccatcttcccggagccaacggtgttccacaaaaccatcaagacgagagtcgagggctactttacggatcggaacattgatcccaagaatagaccagagatctggggacgatacgctcttatctttggatccttgatcgcttcctactacgcgcagctctttgtgcctttcgttgtcgaacgcacatggcttcaggtggtgtttgcaatcatcatgggatttgcgtgcgcacaagtcggactcaaccctcttcatgatgcgtctcacttttcagtgacccacaaccccactgtctggaagattctgggagccacgcacgactttttcaacggagcatcgtacctggtgtggatgtaccaacatatgctcggccatcacccctacaccaacattgctggagcagatcccgacgtgtcgacgtctgagcccgatgttcgtcgtatcaagcccaaccaaaagtggtttgtcaaccacatcaaccagcacatgtttgttcctttcctgtacggactgctggcgttcaaggtgcgcattcaggacatcaacattttgtactttgtcaagaccaatgacgctattcgtgtcaatcccatctcgacatggcacactgtgatgttctggggcggcaaggctttctttgtctggtatcgcctgattgttcccctgcagtatctgcccctgggcaaggtgctgctcttgttcacggtcgcggacatggtgtcgtcttactggctggcgctgaccttccaggcgaaccacgttgttgaggaagttcagtggccgttgcctgacgagaacgggatcatccaaaaggactgggcagctatgcaggtcgagactacgcaggattacgcacacgattcgcacctctggaccagcatcactggcagcttgaactaccaggctgtgcaccatctgttccccaacgtgtcgcagcaccattatcccgatattctggccatcatcaagaacacctgcagcgagtacaaggttccataccttgtcaaggatacgttttggcaagcatttgcttcacatttggagcacttgcgtgttcttggactccgtcccaaggaagagtaggc

SEQ ID NO: 119 - DNA, 1338 bp, Mortierella alpina
atgggaacggaccaaggaaaaaccttcacctgggaagagctggcggcccataacaccaaggacgacctactcttggccatccgcggcagggtgtacgatgtcacaaagttcttgagccgccatcctggtggagtggacactctcctgctcggagctggccgagatgttactccggtctttgagatgtatcacgcgtttggggctgcagatgccattatgaagaagtactatgtcggtacactggtctcgaatgagctgcccatcttcccggagccaacggtgttccacaaaaccatcaagacgagagtcgagggctactttacggatcggaacattgatcccaagaatagaccagagatctggggacgatacgctcttatctttggatccttgatcgcttcctactacgcgcagctctttgtgcctttcgttgtcgaacgcacatggcttcaggtggtgtttgcaatcatcatgggatttgcgtgcgcacaagtcggactcaaccctcttcatgatgcgtctcacttttcagtgacccacaaccccactgtctggaagattctgggagccacgcacgactttttcaacggagcatcgtacctggtgtggatgtaccaacatatgctcggccatcacccctacaccaacattgctggagcagatcccgacgtgtcgacgtctgagcccgatgttcgtcgtatcaagcccaaccaaaagtggtttgtcaaccacatcaaccagcacatgtttgttcctttcctgtacggactgctggcgttcaaggtgcgcattcaggacatcaacattttgtactttgtcaagaccaatgacgctattcgtgtcaatcccatctcgacatggcacactgtgatgttctggggcggcaaggctttctttgtctggtatcgcctgattgttcccctgcagtatctgcccctgggcaaggtgctgctcttgttcacggtcgcggacatggtgtcgtcttactggctggcgctgaccttccaggcgaaccacgttgttgaggaagttcagtggccgttgcctgacgagaacgggatcatccaaaaggactgggcagctatgcaggtcgagactacgcaggattacgcacacgattcgcacctctggaccagcatcactggcagcttgaactaccaggctgtgcaccatctgttccccaacgtgtcgcagcaccattatcccgatattctggccatcatcaagaacacctgcagcgagtacaaggttccataccttgtcaaggatacgttttggcaagcatttgcttcacatttggagcacttgcgtgttcttggactccgtcccaaggaagag

SEQ ID NO: 120 - DNA, 2577 bp, Artificial Sequence
  plasmid pKR277
agcttggatctcctgcaggatctggccggccggatctcgtacggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgcca

SEQ ID NO: 121 - DNA, 5364 bp, Artificial Sequence
  plasmid pKR952
ggctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgcggccgcatgggaacggaccaaggaaaaaccttcacctgggaagagctggcggcccataacaccaaggacgacctactcttggccatccgcggcagggtgtacgatgtcacaaagttcttgagccgccatcctggtggagtggacactctcctgctcggagctggccgagatgttactccggtctttgagatgtatcacgcgtttggggctgcagatgccattatgaagaagtactatgtcggtacactggtctcgaatgagctgcccatcttcccggagccaacggtgttccacaaaaccatcaagacgagagtcgagggctactttacggatcggaacattgatcccaagaatagaccagagatctggggacgatacgctcttatctttggatccttgatcgcttcctactacgcgcagctctttgtgcctttcgttgtcgaacgcacatggcttcaggtggtgtttgcaatcatcatgggatttgcgtgcgcacaagtcggactcaaccctcttcatgatgcgtctcacttttcagtgacccacaaccccactgtctggaagattctgggagccacgcacgactttttcaacggagcatcgtacctggtgtggatgtaccaacatatgctcggccatcacccctacaccaacattgctggagcagatcccgacgtgtcgacgtctgagcccgatgttcgtcgtatcaagcccaaccaaaagtggtttgtcaaccacatcaaccagcacatgtttgttcctttcctgtacggactgctggcgttcaaggtgcgcattcaggacatcaacattttgtactttgtcaagaccaatgacgctattcgtgtcaatcccatctcgacatggcacactgtgatgttctggggcggcaaggctttctttgtctggtatcgcctgattgttcccctgcagtatctgcccctgggcaaggtgctgctcttgttcacggtcgcggacatggtgtcgtcttactggctggcgctgaccttccaggcgaaccacgttgttgaggaagttcagtggccgttgcctgacgagaacgggatcatccaaaaggactgggcagctatgcaggtcgagactacgcaggattacgcacacgattcgcacctctggaccagcatcactggcagcttgaactaccaggctgtgcaccatctgttccccaacgtgtcgcagcaccattatcccgatattctggccatcatcaagaacacctgcagcgagtacaaggttccataccttgtcaaggatacgttttggcaagcatttgcttcacatttggagcacttgcgtgttcttggactccgtcccaaggaagagtaggcggccgcatttcgcaccaaatcaatgaaagtaataatgaaaagtctgaataagaatacttaggcttagatgcctttgttacttgtgtaaaataacttgagtcatgtacctttggcggaaacagaataaataaaaggtgaaattccaatgctctatgtataagttagtaatacttaatgtgttctacggttgtttcaatatcatcaaactctaattgaaactttagaaccacaaatctcaatcttttcttaatgaaatgaaaaatcttaattgtaccatgtttatgttaaacaccttacaattggttggagaggaggaccaaccgatgggacaacattgggagaaagagattcaatggagatttggataggagaacaacattctttttcacttcaatacaagatgagtgcaacactaaggatatgtatgagactttcagaagctacgacaacatagatgagtgaggtggtgattcctagcaagaaagacattagaggaagccaaaatcgaacaaggaagacatcaagggcaagagacaggaccatccatctcaggaaaaggagctttgggatagtccgagaagttgtacaagaaattttttggagggtgagtgatgcattgctggtgactttaactcaatcaaaattgagaaagaaagaaaagggagggggctcacatgtgaatagaagggaaacgggagaattttacagttttgatctaatgggcatcccagctagtggtaacatattcaccatgtttaaccttcacgtacggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttggatctcctgca

SEQ ID NO: 122 - DNA, 5252 bp, Artificial Sequence
  plasmid pKR457
  misc_feature (3872)..(3872): n is a, c, g, or t
gtacgtgggcggatcccccgggctgcaggaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactcgacgtacgtcctcgaagagaagggttaataacacattttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccggtctagaggatccaaggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgc

SEQ ID NO: 123 - DNA, 2635 bp, Artificial Sequence
  modified Kti/NotI/Kti3'Salb3' cassette
  misc_feature (1229)..(1229): n is a, c, g, or t
ggtaccgggccccccctcgaggtcgcccgggggatccgccctaagcttcgtacgtcctcgaagagaagggttaataacacattttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccggtctagaggatccaaggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgcgtacgtctagaggatccccgggtacc

SEQ ID NO: 124 - DNA, 1269 bp, Pavlova lutheri
  ref <302>: TITLE: DELTA-8 DESATURASE AND ITS USE IN MAKING POLYUNSATURATED FATTY ACIDS
  ref <310>: PATENT DOCUMENT NUMBER: WO 2007/127381
  ref <311>: PATENT FILING DATE: 2007-04-26
  ref <312>: PUBLICATION DATE: 2007-11-08
  ref <313>: RELEVANT RESIDUES IN SEQ ID NO: (1)..(1269)
atgggcaagggtggagacggcggcgcgcaggcggtgagcgggaccgacgcgtctctcgctgaggtgagctccgtcgatagcaagagcgtgcacgtcgtgctctacggcaagcgcgtggatgtcacaaagttccagaaggcacacccgggcgggagcaaggtgttccgcatcttccaggagcgcgacgcgacggagcagttcgagtcttaccactcgcccaaggccatcaagatgatggagggcatgctcaagaagtcggaggatgcgcccgcttccgtgcccctgccctcgcggtccaccatgggcacggagttcaaggagatgattgagcgccacaagagggctggtctctacgacccttgcccgttggacgagctgttcaagctcaccatcgtccttgcgcccatcttcgtgggcgcctatctcgtgcggagcggcgtctcgcccctcgcgggcgcgctctccatgggctttggcttctacctcgacggctggcttgctcacgactacctgcatcacgcagtcttcaagggctcggtcaacacgctcgtcaaggcgaacaacgccatgggatacgccctcggcttcctccagggctacgacgtggcctggtggcgcgcgcgccataacacgcaccacgtgtgcaccaacgaggatggttcggacccggacatcaagacggcgcccctgctcatctacgtgcgagagaacccgtccattgccaagcggctcaacttcttccagcgctggcagcagtactactatgtgccgaccatggccatcctcgacctctactggcgcctggagtccatcgcgtacgtggctgtgcgcctgcctaagatgtggatgcaggccgccgctcttgccgctcactacgcgctcctgtgctgggtcttcgcagcgcatctcaacctcatccctctcatgatggttgcacgcggcttcgcgacgggcatcgttgtctttgcaacccactatggtgaggacatcctcgaccgcgagcacgtcgagggcatgacgctcgtcgagcagaccgccaagacctcccgtaacatcacgggcggctggctagtgaacgtgctcacgggcttcatctccctgcagaccgagcatcacctcttccccatgatgcccaccggcaacctaatgactatccagcccgaggtacgcgacttcttcaagaagcatggcctcgagtaccgcgagggcaacctcttccagtgcgtgcaccagaacatcaaggctctcgccttcgagcacctcctccac

SEQ ID NO: 125 - DNA, 30 bp, Artificial Sequence
  primer PvDES5'Not-1
gcggccgcaccatgggcaagggtggagacg

SEQ ID NO: 126 - DNA, 27 bp, Artificial Sequence
  primer PvDES3'Not-1
gcggccgctcagtggaggaggtgctcg

SEQ ID NO: 127 - DNA, 9276 bp, Artificial Sequence
  plasmid pKR970
  misc_feature (6592)..(6592): n is a, c, g, or t
gtacggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttggatctcctgcaggctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgcggccgcatgggaacggaccaaggaaaaaccttcacctgggaagagctggcggcccataacaccaaggacgacctactcttggccatccgcggcagggtgtacgatgtcacaaagttcttgagccgccatcctggtggagtggacactctcctgctcggagctggccgagatgttactccggtctttgagatgtatcacgcgtttggggctgcagatgccattatgaagaagtactatgtcggtacactggtctcgaatgagctgcccatcttcccggagccaacggtgttccacaaaaccatcaagacgagagtcgagggctactttacggatcggaacattgatcccaagaatagaccagagatctggggacgatacgctcttatctttggatccttgatcgcttcctactacgcgcagctctttgtgcctttcgttgtcgaacgcacatggcttcaggtggtgtttgcaatcatcatgggatttgcgtgcgcacaagtcggactcaaccctcttcatgatgcgtctcacttttcagtgacccacaaccccactgtctggaagattctgggagccacgcacgactttttcaacggagcatcgtacctggtgtggatgtaccaacatatgctcggccatcacccctacaccaacattgctggagcagatcccgacgtgtcgacgtctgagcccgatgttcgtcgtatcaagcccaaccaaaagtggtttgtcaaccacatcaaccagcacatgtttgttcctttcctgtacggactgctggcgttcaaggtgcgcattcaggacatcaacattttgtactttgtcaagaccaatgacgctattcgtgtcaatcccatctcgacatggcacactgtgatgttctggggcggcaaggctttctttgtctggtatcgcctgattgttcccctgcagtatctgcccctgggcaaggtgctgctcttgttcacggtcgcggacatggtgtcgtcttactggctggcgctgaccttccaggcgaaccacgttgttgaggaagttcagtggccgttgcctgacgagaacgggatcatccaaaaggactgggcagctatgcaggtcgagactacgcaggattacgcacacgattcgcacctctggaccagcatcactggcagcttgaactaccaggctgtgcaccatctgttccccaacgtgtcgcagcaccattatcccgatattctggccatcatcaagaacacctgcagcgagtacaaggttccataccttgtcaaggatacgttttggcaagcatttgcttcacatttggagcacttgcgtgttcttggactccgtcccaaggaagagtaggcggccgcatttcgcaccaaatcaatgaaagtaataatgaaaagtctgaataagaatacttaggcttagatgcctttgttacttgtgtaaaataacttgagtcatgtacctttggcggaaacagaataaataaaaggtgaaattccaatgctctatgtataagttagtaatacttaatgtgttctacggttgtttcaatatcatcaaactctaattgaaactttagaaccacaaatctcaatcttttcttaatgaaatgaaaaatcttaattgtaccatgtttatgttaaacaccttacaattggttggagaggaggaccaaccgatgggacaacattgggagaaagagattcaatggagatttggataggagaacaacattctttttcacttcaatacaagatgagtgcaacactaaggatatgtatgagactttcagaagctacgacaacatagatgagtgaggtggtgattcctagcaagaaagacattagaggaagccaaaatcgaacaaggaagacatcaagggcaagagacaggaccatccatctcaggaaaaggagctttgggatagtccgagaagttgtacaagaaattttttggagggtgagtgatgcattgctggtgactttaactcaatcaaaattgagaaagaaagaaaagggagggggctcacatgtgaatagaagggaaacgggagaattttacagttttgatctaatgggcatcccagctagtggtaacatattcaccatgtttaaccttcacgtaccgggccccccctcgaggtcgcccgggggatccgccctaagcttcgtacgtcctcgaagagaagggttaataacacattttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggccgcaccatgggcaagggtggagacggcggcgcgcaggcggtgagcgggaccgacgcgtctctcgctgaggtgagctccgtcgatagcaagagcgtgcacgtcgtgctctacggcaagcgcgtggatgtcacaaagttccagaaggcacacccgggcgggagcaaggtgttccgcatcttccaggagcgcgacgcgacggagcagttcgagtcttaccactcgcccaaggccatcaagatgatggagggcatgctcaagaagtcggaggatgcgcccgcttccgtgcccctgccctcgcggtccaccatgggcacggagttcaaggagatgattgagcgccacaagagggctggtctctacgacccttgcccgttggacgagctgttcaagctcaccatcgtccttgcgcccatcttcgtgggcgcctatctcgtgcggagcggcgtctcgcccctcgcgggcgcgctctccatgggctttggcttctacctcgacggctggcttgctcacgactacctgcatcacgcagtcttcaagggctcggtcaacacgctcgtcaaggcgaacaacgccatgggatacgccctcggcttcctccagggctacgacgtggcctggtggcgcgcgcgccataacacgcaccacgtgtgcaccaacgaggatggttcggacccggacatcaagacggcgcccctgctcatctacgtgcgagagaacccgtccattgccaagcggctcaacttcttccagcgctggcagcagtactactatgtgccgaccatggccatcctcgacctctactggcgcctggagtccatcgcgtacgtggctgtgcgcctgcctaagatgtggatgcaggccgccgctcttgccgctcactacgcgctcctgtgctgggtcttcgcagcgcatctcaacctcatccctctcatgatggttgcacgcggcttcgcgacgggcatcgttgtctttgcaacccactatggtgaggacatcctcgaccgcgagcacgtcgagggcatgacgctcgtcgagcagaccgccaagacctcccgtaacatcacgggcggctggctagtgaacgtgctcacgggcttcatctccctgcagaccgagcatcacctcttccccatgatgcccaccggcaacctaatgactatccagcccgaggtacgcgacttcttcaagaagcatggcctcgagtaccgcgagggcaacctcttccagtgcgtgcaccagaacatcaaggctctcgccttcgagcacctcctccactgagcggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccggtctagaggatccaaggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgcgtacgtctagaggatccccgg

SEQ ID NO: 128 - DNA, 11366 bp, Artificial Sequence
  plasmid pKR973
  misc_feature (5237)..(5237): n is a, c, g, or t
ggagatccaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcagatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacccggggatcctctagacgtacgcaaaggcaaagatttaaactcgaaaacattacaaaagtctcaaaacagaggcaaggccatgcacaaagcacactctaagtgcttccattgcctactaagtagggtacgtacacgatcaccattcaccagtgatgatctttattaatatacaacacactcagagacagcttatgttatagctagctagcataaactatcacatcatgtgttagtacgacaagtgacaacattgcttttaacttcgcggccttggatcctctagaccggatataatgagccgtaaacaaagatgattaagtagtaattaatacgtactagtaaaagtggcaaaagataacgagaaagaaccaatttctttgcattcggccttagcggaaggcatatataagctttgattattttatttagtgtaatgatttcgtacaaccaaagcatttatttagtactctcacacttgtgtcgcggccgctcagtggaggaggtgctcgaaggcgagagccttgatgttctggtgcacgcactggaagaggttgccctcgcggtactcgaggccatgcttcttgaagaagtcgcgtacctcgggctggatagtcattaggttgccggtgggcatcatggggaagaggtgatgctcggtctgcagggagatgaagcccgtgagcacgttcactagccagccgcccgtgatgttacgggaggtcttggcggtctgctcgacgagcgtcatgccctcgacgtgctcgcggtcgaggatgtcctcaccatagtgggttgcaaagacaacgatgcccgtcgcgaagccgcgtgcaaccatcatgagagggatgaggttgagatgcgctgcgaagacccagcacaggagcgcgtagtgagcggcaagagcggcggcctgcatccacatcttaggcaggcgcacagccacgtacgcgatggactccaggcgccagtagaggtcgaggatggccatggtcggcacatagtagtactgctgccagcgctggaagaagttgagccgcttggcaatggacgggttctctcgcacgtagatgagcaggggcgccgtcttgatgtccgggtccgaaccatcctcgttggtgcacacgtggtgcgtgttatggcgcgcgcgccaccaggccacgtcgtagccctggaggaagccgagggcgtatcccatggcgttgttcgccttgacgagcgtgttgaccgagcccttgaagactgcgtgatgcaggtagtcgtgagcaagccagccgtcgaggtagaagccaaagcccatggagagcgcgcccgcgaggggcgagacgccgctccgcacgagataggcgcccacgaagatgggcgcaaggacgatggtgagcttgaacagctcgtccaacgggcaagggtcgtagagaccagccctcttgtggcgctcaatcatctccttgaactccgtgcccatggtggaccgcgagggcaggggcacggaagcgggcgcatcctccgacttcttgagcatgccctccatcatcttgatggccttgggcgagtggtaagactcgaactgctccgtcgcgtcgcgctcctggaagatgcggaacaccttgctcccgcccgggtgtgccttctggaactttgtgacatccacgcgcttgccgtagagcacgacgtgcacgctcttgctatcgacggagctcacctcagcgagagacgcgtcggtcccgctcaccgcctgcgcgccgccgtctccacccttgcccatggtgcggccgcttggggggctatggaagactttcttagttagttgtgtgaataagcaatgttgggagaatcgggactacttataggataggaataaaacagaaaagtattaagtgctaatgaaatatttagactgataattaaaatcttcacgtatgtccacttgatataaaaacgtcaggaataaaggaagtacagtagaatttaaaggtactctttttatatatacccgtgttctctttttggctagctagttgcataaaaaataatctatatttttatcattattttaaatatcttatgagatggtaaatatttatcataattttttttactattatttattatttgtgtgtgtaatacatatagaagttaattacaaattttatttactttttcattattttgatatgattcaccattaatttagtgttattatttataatagttcattttaatctttttgtatatattatgcgtgcagtacttttttcctacatataactactattacattttatttatataatatttttattaatgaattttcgtgataatatgtaatattgttcattattatttcagattttttaaaaatatttgtgttattatttatgaaatatgtaatttttttagtatttgattttatgatgataaagtgttctaaattcaaaagaagggggaaagcgtaaacattaaaaaacgtcatcaaacaaaaacaaaatcttgttaataaagataaaactgtttgttttgatcactgttatttcgtaatataaaaacattatttatatttatattgttgacaaccaaatttgcctatcaaatctaaccaatataatgcatgcgtggcaggtaatgtactaccatgaacttaagtcatgacataataaaccgtgaatctgaccaatgcatgtacctanctaaattgtatttgtgacacgaagcaaatgattcaattcacaatggagatgggaaacaaataatgaagaacccagaactaagaaagcttttctgaaaaataaaataaaggcaatgtcaaaagtatactgcatcatcagtccagaaagcacatgatatttttttatcagtatcaatgcagctagttttattttacaatatcgatatagctagtttaaatatattgcagctagatttataaatatttgtgttattatttatcatttgtgtaatcctgtttttagtattttagtttatatatgatgataatgtattccaaatttaaaagaagggaaataaatttaaacaagaaaaaaagtcatcaaacaaaaaacaaatgaaagggtggaaagatgttaccatgtaatgtgaatgttacagtatttcttttattatagagttaacaaattaactaatatgattttgttaataatgataaaatattttttttattattatttcataatataaaaatagtttacttaatataaaaaaaattctatcgttcacaacaaagttggccacctaatttaaccatgcatgtacccatggaccatattaggtaaccatcaaacctgatgaagagataaagagatgaagacttaagtcataacacaaaaccataaaaaacaaaaatacaatcaaccgtcaatctgaccaatgcatgaaaaagctgcaatagtgagtggcgacacaaagcacatgattttcttacaacggagataaaaccaaaaaaatatttcatgaacaacctagaacaaataaagcttttatataataaatatataaataaataaaggctatggaataatatacttcaatatatttggattaaataaattgttggcggggttgatatatttatacacacctaaagtcacttcaatctcattttcacttaacttttattttttttttctttttatttatcataaagagaatattgataatatactttttaacatatttttatgacattttttattggtgaaaacttattaaaaatcataaattttgtaagttagatttatttaaagagttcctcttcttattttaaattttttaataaatttttaaataactaaaatttgtgttaaaaatgttaaaaaatgtgttattaacccttctcttcgaggacgtacgaagcttagggcggatcccccgggcgacctcgagggggggcccggtacgtgaaggttaaacatggtgaatatgttaccactagctgggatgcccattagatcaaaactgtaaaattctcccgtttcccttctattcacatgtgagccccctcccttttctttctttctcaattttgattgagttaaagtcaccagcaatgcatcactcaccctccaaaaaatttcttgtacaacttctcggactatcccaaagctccttttcctgagatggatggtcctgtctcttgcccttgatgtcttccttgttcgattttggcttcctctaatgtctttcttgctaggaatcaccacctcactcatctatgttgtcgtagcttctgaaagtctcatacatatccttagtgttgcactcatcttgtattgaagtgaaaaagaatgttgttctcctatccaaatctccattgaatctctttctcccaatgttgtcccatcggttggtcctcctctccaaccaattgtaaggtgtttaacataaacatggtacaattaagatttttcatttcattaagaaaagattgagatttgtggttctaaagtttcaattagagtttgatgatattgaaacaaccgtagaacacattaagtattactaacttatacatagagcattggaatttcaccttttatttattctgtttccgccaaaggtacatgactcaagttattttacacaagtaacaaaggcatctaagcctaagtattcttattcagacttttcattattactttcattgatttggtgcgaaatgcggccgcctactcttccttgggacggagtccaagaacacgcaagtgctccaaatgtgaagcaaatgcttgccaaaacgtatccttgacaaggtatggaaccttgtactcgctgcaggtgttcttgatgatggccagaatatcgggataatggtgctgcgacacgttggggaacagatggtgcacagcctggtagttcaagctgccagtgatgctggtccagaggtgcgaatcgtgtgcgtaatcctgcgtagtctcgacctgcatagctgcccagtccttttggatgatcccgttctcgtcaggcaacggccactgaacttcctcaacaacgtggttcgcctggaaggtcagcgccagccagtaagacgacaccatgtccgcgaccgtgaacaagagcagcaccttgcccaggggcagatactgcaggggaacaatcaggcgataccagacaaagaaagccttgccgccccagaacatcacagtgtgccatgtcgagatgggattgacacgaatagcgtcattggtcttgacaaagtacaaaatgttgatgtcctgaatgcgcaccttgaacgccagcagtccgtacaggaaaggaacaaacatgtgctggttgatgtggttgacaaaccacttttggttgggcttgatacgacgaacatcgggctcagacgtcgacacgtcgggatctgctccagcaatgttggtgtaggggtgatggccgagcatatgttggtacatccacaccaggtacgatgctccgttgaaaaagtcgtgcgtggctcccagaatcttccagacagtggggttgtgggtcactgaaaagtgagacgcatcatgaagagggttgagtccgacttgtgcgcacgcaaatcccatgatgattgcaaacaccacctgaagccatgtgcgttcgacaacgaaaggcacaaagagctgcgcgtagtaggaagcgatcaaggatccaaagataagagcgtatcgtccccagatctctggtctattcttgggatcaatgttccgatccgtaaagtagccctcgactctcgtcttgatggttttgtggaacaccgttggctccgggaagatgggcagctcattcgagaccagtgtaccgacatagtacttcttcataatggcatctgcagccccaaacgcgtgatacatctcaaagaccggagtaacatctcggccagctccgagcaggagagtgtccactccaccaggatggcggctcaagaactttgtgacatcgtacaccctgccgcggatggccaagagtaggtcgtccttggtgttatgggccgccagctcttcccaggtgaaggtttttccttggtccgttcccatgcggccgcggtgatgactgatgagtgtttaaggaccaatggagagaatgtttgagttgtgaagcggagaacctgaggcgtggttatttatagggaagagaggaaggtgaatgagggacacgtcacagaagtagggtgctgagcttgagacattcttcagtatgcatggctatggaagccttgggtgctacacctcatgaagttcatggtgtgaggtggcttcggcatctcaattaagtgacaaagagaaaggtgtttcagtgtttctattgcaaatggcagaaactcgtgatgacgaggggaccatgcatggtttcatttcttttcttcctggattctttctttccttttatatatgcaggttcataatttaaaaattagactcgctttcaatttcttaatttctcattttcctcttatattactgtactaatgttaaccacgtacacttattttttttttagtttaattttgatagattgtgttgatttaaacatattaatattttcaaccaaataaaaatcattttagtagatacggctttttaaataattattaaaaatattaactatttatcctaaatggcacattttaattaaaaaaaatccggtgttgtaagtgttttattaatttgttttggcattattaaagcaactttttttttatttgttggcattttgagtacgtacttaggctagcctgcaggccaactgcgtttggggctccagattaaacgacgccgtttcgttcctttcgcttcacggcttaacgatgtcgtttctgtctgtgcccaaaaaataaaggcatttgttatttgcaccagatatttactaagtgcaccctagtttgacaagtaggcgataattacaaatagatgcggtgcaaataataaattttgaaggaaataattacaaaagaacagaacttatatttactttattttaaaaaactaaaatgaaagaacaaaaaaagtaaaaaatacaaaaaatgtgctttaaccactttcattatttgttacagaaagtatgattctactcaaattgatctgttgtatctggtgctgccttgtcacactggcgatttcaatcccctaaagatatggtgcaaactgcgaagtgatcaatatctgctcggttaatttagattaattaataatattcaacgtgatgtaccaaaaaaagacaattttttgctccattgacaaattaaacctcatcaaggtaatttccaaacctataagcaaaaaaatttcacattaattggcccgcaatcctattagtcttattatactagagtaggaaaaaaaacaattacacaacttgtcttattattctctatgctaatgaatatttttcccttttgttagaaatcagtgtttcctaatttattgagtattaattccactcaccgcatatatttaccgttgaataagaaaattttacacataattctttttaagataaataatttttttatactagatcttatatgattacgtgaagccaagtgggttatactaatgatatataatgtttgatagtaatcagtttataaaccaaatgcatggaaatgttacgtggaagcacgtaaattaacaagcattgaagcaaatgcagccaccgcaccaaaaccaccccacttcacttccacgtaccatattccatgcaactacaacaccctaaaacttcaataaatgcccccaccttcacttcacttcacccatcaatagcaagcggccgcaccatggaggtggtgaatgaaatagtctcaattgggcaggaagttttacccaaagttgattatgcccaactctggagtgatgccagtcactgtgaggtgctttacttgtccatcgcatttgtcatcttgaagttcactcttggcccccttggtccaaaaggtcagtctcgtatgaagtttgttttcaccaattacaaccttctcatgtccatttattcgttgggatcattcctctcaatggcatatgccatgtacaccatcggtgttatgtctgacaactgcgagaaggcttttgacaacaacgtcttcaggatcaccacgcagttgttctatttgagcaagttcctggagtatattgactccttctatttgccactgatgggcaagcctctgacctggttgcaattcttccatcatttgggggcaccgatggatatgtggctgttctataattaccgaaatgaagctgtttggatttttgtgctgttgaatggtttcatccactggatcatgtacggttattattggaccagattgatcaagctgaagttccccatgccaaaatccctgattacatcaatgcagatcattcaattcaatgttggtttctacattgtctggaagtacaggaacattccctgttatcgccaagatgggatgaggatgtttggctggttcttcaattacttttatgttggcacagtcttgtgtttgttcttgaatttctatgtgcaaacgtatatcgtcaggaagcacaagggagccaaaaagattcagtgagcggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgcgtacgtctagagtcgacctgca

SEQ ID NO: 129 - DNA, 6021 bp, Artificial Sequence
  plasmid pKR271
ggccgcgaattcaatcactagtgaattcgcggccgcatgagccgtaaaggttcaatacaacgagtgcttgttttcttagggacaagcattgtacttatgtatgattctgtgtaaccatgagtcttccacgttgtactaatgtgaagggcaaaaataaaacacagaacaagttcgtttttctcaaataatgtgaaggtagaaaatggaaccatgcctcctctcttgcatgtgatttaaaatattagcagatggtaccgtacgtgggcggatcccccgggctgcaggaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactcgacgtacgatcccacatgcaagtttttatttcaatcccttttcctttgaataactgaccaagaacaacaagaaaaaaaaaaaaaaagaaaaggatcattttgaaaggatatttttcgctcctattcaaatactgtatttttaccaaaaaaactgtatttttcctacactctcaagctttgtttttcgcttcgactctcatgatttccttcatatgccaatcactctatttataaatggcataaggtagtgtgaacaattgcaaagcttgtcatcaaaagcttgcaatgtacaaattaatgtttttcatgcctttcaaaattatctgcaccccctagctattaatctaacatctaagtaaggctagtgaattttttcgaatagtcatgcagtgcattaatttccccgtgactattttggctttgactccaacactggccccgtacatccgtccctcattacatgaaaagaaatattgtttatattcttaattaaaaatattgtcccttctaaattttcatatagttaattattatattacttttttctctattctattagttctattttcaaattattatttatgcatatgtaaagtacattatatttttgctatatacttaaatatttctaaattattaaaaaaagactgatatgaaaaatttattctttttaaagctatatcattttatatatactttttcttttcttttctttcattttctattcaatttaataagaaataaattttgtaaatttttatttatcaatttataaaaatattttactttatatgttttttcacatttttgttaaacaaatcatatcattatgattgaaagagaggaaattgacagtgagtaataagtgatgagaaaaaaatgtgttatttcctaaaaaaaacctaaacaaacatgtatctactctctatttcatctatctctcatttcatttttctctttatctctttctttatttttttatcatatcatttcacattaattatttttactctctttattttttctctctatccctctcttatttccactcatatatacactccaaaattggggcatgcctttatcactactctatctcctccactaaatcatttaaatgaaactgaaaagcattggcaagtctcctcccctcctcaagtgatttccaactcagcattggcatctaattgattcagtatatctattgcatgtgtaaaagtctttccacaatacataactattaattaatcttaaataaataaaggataaaatatttttttttcttcataaaattaaaatatgttattttttgtttagatgtatattcgaataaatctaaatatatgataatgattttttatattgattaaacatataatcaatattaaatatgatatttttttatataggttgtacacataattttataaggataaaaaatatgataaaaataaattttaaatatttttatatttacgagaaaaaaaaatattttagccataaataaatgaccagcatattttacaaccttagtaattcataaattcctatatgtatatttgaaattaaaaacagataatcgttaagggaaggaatcctacgtcatctcttgccatttgtttttcatgcaaacagaaagggacgaaaaaccacctcaccatgaatcactcttcacaccatttttactagcaaacaagtctcaacaactgaagccagctctctttccgtttctttttacaacactttctttgaaatagtagtatttttttttcacatgatttattaacgtgccaaaagatgcttattgaatagagtgcacatttgtaatgtactactaattagaacatgaaaaagcattgttctaacacgataatcctgtgaaggcgttaactccaaagatccaatttcactatataaattgtgacgaaagcaaaatgaattcacatagctgagagagaaaggaaaggttaactaagaagcaatacttcagcggccgcatgactgaggataagacgaaggtcgagttcccgacgctcacggagctcaagcactcgatcccgaacgcgtgctttgagtcgaacctcggcctctcgctctactacacggcccgcgcgatcttcaacgcgtcggcctcggcggcgctgctctacgcggcgcgctcgacgccgttcattgccgataacgttctgctccacgcgctcgtttgcgccacctacatctacgtgcagggcgtcatcttctggggcttcttcacggtcggccacgactgcggccactcggccttctcgcgctaccacagcgtcaactttatcatcggctgcatcatgcactctgcgattttgacgccgttcgagagctggcgcgtgacgcaccgccaccaccacaagaacacgggcaacattgataaggacgagatcttttacccgcaccggtcggtcaaggacctccaggacgtgcgccaatgggtctacacgctcggcggtgcgtggtttgtctacttgaaggtcgggtatgccccgcgcacgatgagccactttgacccgtgggacccgctcctccttcgccgcgcgtcggccgtcatcgtgtcgctcggcgtctgggccgccttcttcgccgcgtacgcgtacctcacatactcgctcggctttgccgtcatgggcctctactactatgcgccgctctttgtctttgcttcgttcctcgtcattacgaccttcttgcaccacaacgacgaagcgacgccgtggtacggcgactcggagtggacgtacgtcaagggcaacctctcgagcgtcgaccgctcgtacggcgcgttcgtggacaacctgagccaccacattggcacgcaccaggtccaccacttgttcccgatcattccgcactacaagctcaacgaagccaccaagcactttgcggccgcgtacccgcacctcgtgcgcaggaacgacgagcccatcatcacggccttcttcaagaccgcgcacctctttgtcaactacggcgctgtgcccgagacggcgcagatcttcacgctcaaagagtcggccgcggccgccaaggccaagtcggactaagc

SEQ ID NO: 130 - DNA, 6524 bp, Artificial Sequence
  plasmid pKR226
gtacgtctagaggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagctgggtctagaactagaaacgtgatgccacttgttattgaagtcgattacagcatctattctgttttactatttataactttgccatttctgacttttgaaaactatctctggatttcggtatcgctttgtgaagatcgagcaaaagagacgttttgtggacgcaatggtccaaatccgttctacatgaacaaattggtcacaatttccactaaaagtaaataaatggcaagttaaaaaaggaatatgcattttactgattgcctaggtgagctccaagagaagttgaatctacacgtctaccaaccgctaaaaaaagaaaaacattgatatgtaacctgattccattagcttttgacttcttcaacagattctctacttagatttctaacagaaatattattactagcacatcattttcagtctcactacagcaaaaaatccaacggcacaatacagacaacaggagatatcagactacagagatagatagatgctactgcatgtagtaagttaaataaaaggaaaataaaatgtcttgctaccaaaactactacagactatgatgctcaccacaggccaaatcctgcaactaggacagcattatcttatatatattgtacaaaacaagcatcaaggaacatttggtctaggcaatcagtacctcgttctaccatcaccctcagttatcacatccttgaaggatccattactgggaatcatcggcaacacatgctcctgatggggcacaatgacatcaagaaggtaggggccaggggtgtccaacattctctgaattgccgctctaagctcttccttcttcgtcactcgcgctgccggtatcccacaagcatcagcaaacttgagcatgtttgggaatatctcgctctcgctagacggatctccaagataggtgtgagctctattggacttgtagaacctatcctccaactgaaccaccatacccaaatgctgattgttcaacaacaatatcttaactgggagattctccactcttatagtggccaactcctgaacattcatgatgaaactaccatccccatcaatgtcaaccacaacagccccagggttagcaacagcagcaccaatagccgcaggcaatccaaaacccatggctccaagaccccctgaggtcaaccactgcctcggtctcttgtacttgtaaaactgcgcagcccacatttgatgctgcccaaccccagtactaacaatagcatctccattagtcaactcatcaagaacctcgatagcatgctgcggagaaatcgcgtcctggaatgtcttgtaacccaatggaaacttgtgtttctgcacattaatctcttctctccaacctccaagatcaaacttaccctccactcctttctcctccaaaatcatattaattcccttcaaggccaacttcaaatccgcgcaaaccgacacgtgcgcctgcttgttcttcccaatctcggcagaatcaatatcaatgtgaacaatcttagccctactagcaaaagcctcaagcttcccagtaacacggtcatcaaaccttaccccaaaggcaagcaacaaatcactattgtcaacagcatagttagcataaacagtaccatgcatacccagcatctgaagggaatattcatcaccaataggaaaagttccaagacccattaaagtgctagcaacgggaataccagtgagttcaacaaagcgcctcaattcagcactggaattcaaactgccaccgccgacgtagagaacgggcttttgggcctccatgatgagtctgacaatgtgttccaattgggcctcggcggggggcctgggcagcctggcgaggtaaccggggaggttaacgggctcgtcccaattaggcacggcgagttgctgctgaacgtctttgggaatgtcgatgaggaccggaccggggcggccggaggtggcgacgaagaaagcctcggcgacgacgcgggggatgtcgtcgacgtcgaggatgaggtagttgtgcttcgtgatggatctgctcacctccacgatcggggtttcttggaaggcgtcggtgccgatcatccggcgggcgacctggccggtgatggcgacgactgggacgctgtccattaaagcgtcggcgaggccgctcacgaggttggtggcgccggggccggaggtggcaatgcagacgccggggaggccggaggaacgcgcgtagccttcggcggcgaagacgccgccctgctcgtggcgcgggagcacgttgcggatggcggcggagcgcgtgagcgcctggtggatctccatcgacgcaccgccggggtacgcgaacaccgtcgtcacgccctgcctctccagcgcctccacaaggatgtccgcgcccttgcgaggttcgccggaggcgaaccgtgacacgaagggctccgtggtcggcgcttccttggtgaagggcgccgccgtggggggtttggagatggaacatttgattttgagagcgtggttgggtttggtgagggtttgatgagagagagggagggtggatctagtaatgcgtttggggaaggtggggtgtgaagaggaagaagagaatcgggtggttctggaagcggtggccgccattgtgttgtgtggcatggttatacttcaaaaactgcacaacaagcctagagttagtacctaaacagtaaatttacaacagagagcaaagacacatgcaaaaatttcagccataaaaaaagttataatagaatttaaagcaaaagtttcattttttaaacatatatacaaacaaactggatttgaaggaagggattaattcccctgctcaaagtttgaattcctattgtgacctatactcgaataaaattgaagcctaaggaatgtatgagaaacaagaaaacaaaacaaaactacagacaaacaagtacaattacaaaattcgctaaaattctgtaatcaccaaaccccatctcagtcagcacaaggcccaaggtttattttgaaataaaaaaaaagtgattttatttctcataagctaaaagaaagaaaggcaattatgaaatgatttcgactagatctgaaagtccaacgcgtattccgcagatattaaagaaagagtagagtttcacatggatcctagatggacccagttgaggaaaaagcaaggcaaagcaaaccagaagtgcaagatccgaaattgaaccacggaatctaggatttggtagagggagaagaaaagtaccttgagaggtagaagagaagagaagagcagagagatatatgaacgagtgtgtcttggtctcaactctgaagcgatacgagtttagaggggagcattgagttccaatttatagggaaaccgggtggcaggggtgagttaatgacggaaaagcccctaagtaacgagattggattgtgggttagattcaaccgtttgcatccgcggcttagattggggaagtcagagtgaatctcaaccgttgactgagttgaaaattgaatgtagcaaccaattgagccaaccccagcctttgccctttgattttgatttgtttgttgcatactttttatttgtcttctggttctgactctctttctctcgtttcaatgccaggttgcctactcccacaccactcacaagaagattctactgttagtattaaatattttttaatgtattaaatgatgaatgcttttgtaaacagaacaagactatgtctaataagtgtcttgcaacattttttaagaaattaaaaaaaatatatttattatcaaaatcaaatgtatgaaaaatcatgaataatataattttatacatttttttaaaaaatcttttaatttcttaattaatatcttaaaaataatgattaatatttaacccaaaataattagtatgattggtaaggaagatatccatgttatgtttggatgtgagtttgatctagagcaaagcttactagagtcgacctgcaggtcgactcgac

SEQ ID NO: 131 - DNA, 9892 bp, Artificial Sequence
  plasmid pKR886r
ggtcgactcgacgtacgtctagaggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagctgggtctagaactagaaacgtgatgccacttgttattgaagtcgattacagcatctattctgttttactatttataactttgccatttctgacttttgaaaactatctctggatttcggtatcgctttgtgaagatcgagcaaaagagacgttttgtggacgcaatggtccaaatccgttctacatgaacaaattggtcacaatttccactaaaagtaaataaatggcaagttaaaaaaggaatatgcattttactgattgcctaggtgagctccaagagaagttgaatctacacgtctaccaaccgctaaaaaaagaaaaacattgatatgtaacctgattccattagcttttgacttcttcaacagattctctacttagatttctaacagaaatattattactagcacatcattttcagtctcactacagcaaaaaatccaacggcacaatacagacaacaggagatatcagactacagagatagatagatgctactgcatgtagtaagttaaataaaaggaaaataaaatgtcttgctaccaaaactactacagactatgatgctcaccacaggccaaatcctgcaactaggacagcattatcttatatatattgtacaaaacaagcatcaaggaacatttggtctaggcaatcagtacctcgttctaccatcaccctcagttatcacatccttgaaggatccattactgggaatcatcggcaacacatgctcctgatggggcacaatgacatcaagaaggtaggggccaggggtgtccaacattctctgaattgccgctctaagctcttccttcttcgtcactcgcgctgccggtatcccacaagcatcagcaaacttgagcatgtttgggaatatctcgctctcgctagacggatctccaagataggtgtgagctctattggacttgtagaacctatcctccaactgaaccaccatacccaaatgctgattgttcaacaacaatatcttaactgggagattctccactcttatagtggccaactcctgaacattcatgatgaaactaccatccccatcaatgtcaaccacaacagccccagggttagcaacagcagcaccaatagccgcaggcaatccaaaacccatggctccaagaccccctgaggtcaaccactgcctcggtctcttgtacttgtaaaactgcgcagcccacatttgatgctgcccaaccccagtactaacaatagcatctccattagtcaactcatcaagaacctcgatagcatgctgcggagaaatcgcgtcctggaatgtcttgtaacccaatggaaacttgtgtttctgcacattaatctcttctctccaacctccaagatcaaacttaccctccactcctttctcctccaaaatcatattaattcccttcaaggccaacttcaaatccgcgcaaaccgacacgtgcgcctgcttgttcttcccaatctcggcagaatcaatatcaatgtgaacaatcttagccctactagcaaaagcctcaagcttcccagtaacacggtcatcaaaccttaccccaaaggcaagcaacaaatcactattgtcaacagcatagttagcataaacagtaccatgcatacccagcatctgaagggaatattcatcaccaataggaaaagttccaagacccattaaagtgctagcaacgggaataccagtgagttcaacaaagcgcctcaattcagcactggaattcaaactgccaccgccgacgtagagaacgggcttttgggcctccatgatgagtctgacaatgtgttccaattgggcctcggcggggggcctgggcagcctggcgaggtaaccggggaggttaacgggctcgtcccaattaggcacggcgagttgctgctgaacgtctttgggaatgtcgatgaggaccggaccggggcggccggaggtggcgacgaagaaagcctcggcgacgacgcgggggatgtcgtcgacgtcgaggatgaggtagttgtgcttcgtgatggatctgctcacctccacgatcggggtttcttggaaggcgtcggtgccgatcatccggcgggcgacctggccggtgatggcgacgactgggacgctgtccattaaagcgtcggcgaggccgctcacgaggttggtggcgccggggccggaggtggcaatgcagacgccggggaggccggaggaacgcgcgtagccttcggcggcgaagacgccgccctgctcgtggcgcgggagcacgttgcggatggcggcggagcgcgtgagcgcctggtggatctccatcgacgcaccgccggggtacgcgaacaccgtcgtcacgccctgcctctccagcgcctccacaaggatgtccgcgcccttgcgaggttcgccggaggcgaaccgtgacacgaagggctccgtggtcggcgcttccttggtgaagggcgccgccgtggggggtttggagatggaacatttgattttgagagcgtggttgggtttggtgagggtttgatgagagagagggagggtggatctagtaatgcgtttggggaaggtggggtgtgaagaggaagaagagaatcgggtggttctggaagcggtggccgccattgtgttgtgtggcatggttatacttcaaaaactgcacaacaagcctagagttagtacctaaacagtaaatttacaacagagagcaaagacacatgcaaaaatttcagccataaaaaaagttataatagaatttaaagcaaaagtttcattttttaaacatatatacaaacaaactggatttgaaggaagggattaattcccctgctcaaagtttgaattcctattgtgacctatactcgaataaaattgaagcctaaggaatgtatgagaaacaagaaaacaaaacaaaactacagacaaacaagtacaattacaaaattcgctaaaattctgtaatcaccaaaccccatctcagtcagcacaaggcccaaggtttattttgaaataaaaaaaaagtgattttatttctcataagctaaaagaaagaaaggcaattatgaaatgatttcgactagatctgaaagtccaacgcgtattccgcagatattaaagaaagagtagagtttcacatggatcctagatggacccagttgaggaaaaagcaaggcaaagcaaaccagaagtgcaagatccgaaattgaaccacggaatctaggatttggtagagggagaagaaaagtaccttgagaggtagaagagaagagaagagcagagagatatatgaacgagtgtgtcttggtctcaactctgaagcgatacgagtttagaggggagcattgagttccaatttatagggaaaccgggtggcaggggtgagttaatgacggaaaagcccctaagtaacgagattggattgtgggttagattcaaccgtttgcatccgcggcttagattggggaagtcagagtgaatctcaaccgttgactgagttgaaaattgaatgtagcaaccaattgagccaaccccagcctttgccctttgattttgatttgtttgttgcatactttttatttgtcttctggttctgactctctttctctcgtttcaatgccaggttgcctactcccacaccactcacaagaagattctactgttagtattaaatattttttaatgtattaaatgatgaatgcttttgtaaacagaacaagactatgtctaataagtgtcttgcaacattttttaagaaattaaaaaaaatatatttattatcaaaatcaaatgtatgaaaaatcatgaataatataattttatacatttttttaaaaaatcttttaatttcttaattaatatcttaaaaataatgattaatatttaacccaaaataattagtatgattggtaaggaagatatccatgttatgtttggatgtgagtttgatctagagcaaagcttactagagtcgacctgcagcccgggggatccgcccacgtacggtaccatctgctaatattttaaatcacatgcaagagaggaggcatggttccattttctaccttcacattatttgagaaaaacgaacttgttctgtgttttatttttgcccttcacattagtacaacgtggaagactcatggttacacagaatcatacataagtacaatgcttgtccctaagaaaacaagcactcgttgtattgaacctttacggctcatgcggccgcgaattcactagtgattgaattcgcggccgcttagtccgacttggccttggcggccgcggccgactctttgagcgtgaagatctgcgccgtctcgggcacagcgccgtagttgacaaagaggtgcgcggtcttgaagaaggccgtgatgatgggctcgtcgttcctgcgcacgaggtgcgggtacgcggccgcaaagtgcttggtggcttcgttgagcttgtagtgcggaatgatcgggaacaagtggtggacctggtgcgtgccaatgtggtggctcaggttgtccacgaacgcgccgtacgagcggtcgacgctcgagaggttgcccttgacgtacgtccactccgagtcgccgtaccacggcgtcgcttcgtcgttgtggtgcaagaaggtcgtaatgacgaggaacgaagcaaagacaaagagcggcgcatagtagtagaggcccatgacggcaaagccgagcgagtatgtgaggtacgcgtacgcggcgaagaaggcggcccagacgccgagcgacacgatgacggccgacgcgcggcgaaggaggagcgggtcccacgggtcaaagtggctcatcgtgcgcggggcatacccgaccttcaagtagacaaaccacgcaccgccgagcgtgtagacccattggcgcacgtcctggaggtccttgaccgaccggtgcgggtaaaagatctcgtccttatcaatgttgcccgtgttcttgtggtggtggcggtgcgtcacgcgccagctctcgaacggcgtcaaaatcgcagagtgcatgatgcagccgatgataaagttgacgctgtggtagcgcgagaaggccgagtggccgcagtcgtggccgaccgtgaagaagccccagaagatgacgccctgcacgtagatgtaggtggcgcaaacgagcgcgtggagcagaacgttatcggcaatgaacggcgtcgagcgcgccgcgtagagcagcgccgccgaggccgacgcgttgaagatcgcgcgggccgtgtagtagagcgagaggccgaggttcgactcaaagcacgcgttcgggatcgagtgcttgagctccgtgagcgtcgggaactcgaccttcgtcttatcctcagtcatgcggccgctgaagtattgcttcttagttaacctttcctttctctctcagctatgtgaattcattttgctttcgtcacaatttatatagtgaaattggatctttggagttaacgccttcacaggattatcgtgttagaacaatgctttttcatgttctaattagtagtacattacaaatgtgcactctattcaataagcatcttttggcacgttaataaatcatgtgaaaaaaaaatactactatttcaaagaaagtgttgtaaaaagaaacggaaagagagctggcttcagttgttgagacttgtttgctagtaaaaatggtgtgaagagtgattcatggtgaggtggtttttcgtccctttctgtttgcatgaaaaacaaatggcaagagatgacgtaggattccttcccttaacgattatctgtttttaatttcaaatatacatataggaatttatgaattactaaggttgtaaaatatgctggtcatttatttatggctaaaatatttttttttctcgtaaatataaaaatatttaaaatttatttttatcatattttttatccttataaaattatgtgtacaacctatataaaaaaatatcatatttaatattgattatatgtttaatcaatataaaaaatcattatcatatatttagatttattcgaatatacatctaaacaaaaaataacatattttaattttatgaagaaaaaaaaatattttatcctttatttatttaagattaattaatagttatgtattgtggaaagacttttacacatgcaatagatatactgaatcaattagatgccaatgctgagttggaaatcacttgaggaggggaggagacttgccaatgcttttcagtttcatttaaatgatttagtggaggagatagagtagtgataaaggcatgccccaattttggagtgtatatatgagtggaaataagagagggatagagagaaaaaataaagagagtaaaaataattaatgtgaaatgatatgataaaaaaataaagaaagagataaagagaaaaatgaaatgagagatagatgaaatagagagtagatacatgtttgtttaggttttttttaggaaataacacatttttttctcatcacttattactcactgtcaatttcctctctttcaatcataatgatatgatttgtttaacaaaaatgtgaaaaaacatataaagtaaaatatttttataaattgataaataaaaatttacaaaatttatttcttattaaattgaatagaaaatgaaagaaaagaaaagaaaaagtatatataaaatgatatagctttaaaaagaataaatttttcatatcagtctttttttaataatttagaaatatttaagtatatagcaaaaatataatgtactttacatatgcataaataataatttgaaaatagaactaatagaatagagaaaaaagtaatataataattaactatatgaaaatttagaagggacaatatttttaattaagaatataaacaatatttcttttcatgtaatgagggacggatgtacggggccagtgttggagtcaaagccaaaatagtcacggggaaattaatgcactgcatgactattcgaaaaaattcactagccttacttagatgttagattaatagctagggggtgcagataattttgaaaggcatgaaaaacattaatttgtacattgcaagcttttgatgacaagctttgcaattgttcacactaccttatgccatttataaatagagtgattggcatatgaaggaaatcatgagagtcgaagcgaaaaacaaagcttgagagtgtaggaaaaatacagtttttttggtaaaaatacagtatttgaataggagcgaaaaatatcctttcaaaatgatccttttctttttttttttttttcttgttgttcttggtcagttattcaaaggaaaagggattgaaataaaaacttgcatgtgggatcgtacgtcgagtcgacctgca

SEQ ID NO: 132 - DNA, 14066 bp, Artificial Sequence
  plasmid pKR1064
ggtcgactcgacgtacgtctagaggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagctgggtctagaactagaaacgtgatgccacttgttattgaagtcgattacagcatctattctgttttactatttataactttgccatttctgacttttgaaaactatctctggatttcggtatcgctttgtgaagatcgagcaaaagagacgttttgtggacgcaatggtccaaatccgttctacatgaacaaattggtcacaatttccactaaaagtaaataaatggcaagttaaaaaaggaatatgcattttactgattgcctaggtgagctccaagagaagttgaatctacacgtctaccaaccgctaaaaaaagaaaaacattgaatatgtaacctgattccattagcttttgacttcttcaacagattctctacttagatttctaacagaaatattattactagcacatcattttcagtctcactacagcaaaaaatccaacggcacaatacagacaacaggagatatcagactacagagatagatagatgctactgcatgtagtaagttaaataaaaggaaaataaaatgtcttgctaccaaaactactacagactatgatgctcaccacaggccaaatcctgcaactaggacagcattatcttatatatattgtacaaaacaagcatcaaggaacatttggtctaggcaatcagtacctcgttctaccatcaccctcagttatcacatccttgaaggatccattactgggaatcatcggcaacacatgctcctgatggggcacaatgacatcaagaaggtaggggccaggggtgtccaacattctctgaattgccgctctaagctcttccttcttcgtcactcgcgctgccggtatcccacaagcatcagcaaacttgagcatgtttgggaatatctcgctctcgctagacggatctccaagataggtgtgagctctattggacttgtagaacctatcctccaactgaaccaccatacccaaatgctgattgttcaacaacaatatcttaactgggagattctccactcttatagtggccaactcctgaacattcatgatgaaactaccatccccatcaatgtcaaccacaacagccccagggttagcaacagcagcaccaatagccgcaggcaatccaaaacccatggctccaagaccccctgaggtcaaccactgcctcggtctcttgtacttgtaaaactgcgcagcccacatttgatgctgcccaaccccagtactaacaatagcatctccattagtcaactcatcaagaacctcgatagcatgctgcggagaaatcgcgtcctggaatgtcttgtaacccaatggaaacttgtgtttctgcacattaatctcttctctccaacctccaagatcaaacttaccctccactcctttctcctccaaaatcatattaattcccttcaaggccaacttcaaatccgcgcaaaccgacacgtgcgcctgcttgttcttcccaatctcggcagaatcaatatcaatgtgaacaatcttagccctactagcaaaagcctcaagcttcccagtaacacggtcatcaaaccttaccccaaaggcaagcaacaaatcactattgtcaacagcatagttagcataaacagtaccatgcatacccagcatctgaagggaatattcatcaccaataggaaaagttccaagacccattaaagtgctagcaacgggaataccagtgagttcaacaaagcgcctcaattcagcactggaattcaaactgccaccgccgacgtagagaacgggcttttgggcctccatgatgagtctgacaatgtgttccaattgggcctcggcggggggcctgggcagcctggcgaggtaaccggggaggttaacgggctcgtcccaattaggcacggcgagttgctgctgaacgtctttgggaatgtcgatgaggaccggaccggggcggccggaggtggcgacgaagaaagcctcggcgacgacgcgggggatgtcgtcgacgtcgaggatgaggtagttgtgcttcgtgatggatctgctcacctccacgatcggggtttcttggaaggcgtcggtgccgatcatccggcgggcgacctggccggtgatggcgacgactgggacgctgtccattaaagcgtcggcgaggccgctcacgaggttggtggcgccggggccggaggtggcaatgcagacgccggggaggccggaggaacgcgcgtagccttcggcggcgaagacgccgccctgctcgtggcgcgggagcacgttgcggatggcggcggagcgcgtgagcgcctggtggatctccatcgacgcaccgccggggtacgcgaacaccgtcgtcacgccctgcctctccagcgcctccacaaggatgtccgcgcccttgcgaggttcgccggaggcgaaccgtgacacgaagggctccgtggtcggcgcttccttggtgaagggcgccgccgtggggggtttggagatggaacatttgattttgagagcgtggttgggtttggtgagggtttgatgagagagagggagggtggatctagtaatgcgtttggggaaggtggggtgtgaagaggaagaagagaatcgggtggttctggaagcggtggccgccattgtgttgtgtggcatggttatacttcaaaaactgcacaacaagcctagagttagtacctaaacagtaaatttacaacagagagcaaagacacatgcaaaaatttcagccataaaaaaagttataatagaatttaaagcaaaagtttcattttttaaacatatatacaaacaaactggatttgaaggaagggattaattcccctgctcaaagtttgaattcctattgtgacctatactcgaataaaattgaagcctaaggaatgtatgagaaacaagaaaacaaaacaaaactacagacaaacaagtacaattacaaaattcgctaaaattctgtaatcaccaaaccccatctcagtcagcacaaggcccaaggtttattttgaaataaaaaaaaagtgattttatttctcataagctaaaagaaagaaaggcaattatgaaatgatttcgactagatctgaaagtcaaacgcgtattccgcagatattaaagaaagagtagagtttcacatggatcctagatggacccagttgaggaaaaagcaaggcaaagcaaaccagaagtgcaagatccgaaattgaaccacggaatctaggatttggtagagggagaagaaaagtaccttgagaggtagaagagaagagaagagcagagagatatatgaacgagtgtgtcttggtctcaactctgaagcgatacgagtttagaggggagcattgagttccaatttatagggaaaccgggtggcaggggtgagttaatgacggaaaagcccctaagtaacgagattggattgtgggttagattcaaccgtttgcatccgcggcttagattggggaagtcagagtgaatctcaaccgttgactgagttgaaaattgaatgtagcaaccaattgagccaaccccagcctttgccctttgattttgatttgtttgttgcatactttttatttgtcttctggttctgactctctttctctcgtttcaatgccaggttgcctactcccacaccactcacaagaagattctactgttagtattaaatattttttaatgtattaaatgatgaatgcttttgtaaacagaacaagactatgtctaataagtgtcttgcaacattttttaagaaattaaaaaaaatatatttattatcaaaatcaaatgtatgaaaaatcatgaataatataattttatacatttttttaaaaaatcttttaatttcttaattaatatcttaaaaataatgattaatatttaacccaaaataattagtatgattggtaaggaagatatccatgttatgtttggatgtgagtttgatctagagcaaagcttactagagtcgacctgcagcccgggggatccgcccacgtacggtaccatctgctaatattttaaatcacatgcaagagaggaggcatggttccattttctaccttcacattatttgagaaaaacgaacttgttctgtgttttatttttgcccttcacattagtacaacgtggaagactcatggttacacagaatcatacataagtacaatgcttgtccctaagaaaacaagcactcgttgtattgaacctttacggctcatgcggccgcgaattcactagtgattgaattcgcggccgcttagtccgacttggccttggcggccgcggccgactctttgagcgtgaagatctgcgccgtctcgggcacagcgccgtagttgacaaagaggtgcgcggtcttgaagaaggccgtgatgatgggctcgtcgttcctgcgcacgaggtgcgggtacgcggccgcaaagtgcttggtggcttcgttgagcttgtagtgcggaatgatcgggaacaagtggtggacctggtgcgtgccaatgtggtggctcaggttgtccacgaacgcgccgtacgagcggtcgacgctcgagaggttgcccttgacgtacgtccactccgagtcgccgtaccacggcgtcgcttcgtcgttgtggtgcaagaaggtcgtaatgacgaggaacgaagcaaagacaaagagcggcgcatagtagtagaggcccatgacggcaaagccgagcgagtatgtgaggtacgcgtacgcggcgaagaaggcggcccagacgccgagcgacacgatgacggccgacgcgcggcgaaggaggagcgggtcccacgggtcaaagtggctcatcgtgcgcggggcatacccgaccttcaagtagacaaaccacgcaccgccgagcgtgtagacccattggcgcacgtcctggaggtccttgaccgaccggtgcgggtaaaagatctcgtccttatcaatgttgcccgtgttcttgtggtggtggcggtgcgtcacgcgccagctctcgaacggcgtcaaaatcgcagagtgcatgatgcagccgatgataaagttgacgctgtggtagcgcgagaaggccgagtggccgcagtcgtggccgaccgtgaagaagccccagaagatgacgccctgcacgtagatgtaggtggcgcaaacgagcgcgtggagcagaacgttatcggcaatgaacggcgtcgagcgcgccgcgtagagcagcgccgccgaggccgacgcgttgaagatcgcgcgggccgtgtagtagagcgagaggccgaggttcgactcaaagcacgcgttcgggatcgagtgcttgagctccgtgagcgtcgggaactcgaccttcgtcttatcctcagtcatgcggccgctgaagtattgcttcttagttaacctttcctttctctctcagctatgtgaattcattttgctttcgtcacaatttatatagtgaaattggatctttggagttaacgccttcacaggattatcgtgttagaacaatgctttttcatgttctaattagtagtacattacaaatgtgcactctattcaataagcatcttttggcacgttaataaatcatgtgaaaaaaaaatactactatttcaaagaaagtgttgtaaaaagaaacggaaagagagctggcttcagttgttgagacttgtttgctagtaaaaatggtgtgaagagtgattcatggtgaggtggtttttcgtccctttctgtttgcatgaaaaacaaatggcaagagatgacgtaggattccttcccttaacgattatctgtttttaatttcaaatatacatataggaatttatgaattactaaggttgtaaaatatgctggtcatttatttatggctaaaatatttttttttctcgtaaatataaaaatatttaaaatttatttttatcatattttttatccttataaaattatgtgtacaacctatataaaaaaatatcatatttaatattgattatatgtttaatcaatataaaaaatcattatcatatatttagatttattcgaatatacatctaaacaaaaaataacatattttaattttatgaagaaaaaaaaatattttatcctttatttatttaagattaattaatagttatgtattgtggaaagacttttacacatgcaatagatatactgaatcaattagatgccaatgctgagttggaaatcacttgaggaggggaggagacttgccaatgcttttcagtttcatttaaatgatttagtggaggagatagagtagtgataaaggcatgccccaattttggagtgtatatatgagtggaaataagagagggatagagagaaaaaataaagagagtaaaaataattaatgtgaaatgatatgataaaaaaataaagaaagagataaagagaaaaatgaaatgagagatagatgaaatagagagtagatacatgtttgtttaggttttttttaggaaataacacatttttttctcatcacttattactcactgtcaatttcctctctttcaatcataatgatatgatttgtttaacaaaaatgtgaaaaaacatataaagtaaaatatttttataaattgataaataaaaatttacaaaatttatttcttattaaattgaatagaaaatgaaagaaaagaaaagaaaaagtatatataaaatgatatagctttaaaaagaataaatttttcatatcagtctttttttaataatttagaaatatttaagtatatagcaaaaatataatgtactttacatatgcataaataataatttgaaaatagaactaatagaatagagaaaaaagtaatataataattaactatatgaaaatttagaagggacaatatttttaattaagaatataaacaatatttcttttcatgtaatgagggacggatgtacggggccagtgttggagtcaaagccaaaatagtcacggggaaattaatgcactgcatgactattcgaaaaaattcactagccttacttagatgttagattaatagctagggggtgcagataattttgaaaggcatgaaaaacattaatttgtacattgcaagcttttgatgacaagctttgcaattgttcacactaccttatgccatttataaatagagtgattggcatatgaaggaaatcatgagagtcgaagcgaaaaacaaagcttgagagtgtaggaaaaatacagtttttttggtaaaaatacagtatttgaataggagcgaaaaatatcctttcaaaatgatccttttctttttttttttttttcttgttgttcttggtcagttattcaaaggaaaagggattgaaataaaaacttgcatgtgggatcgtacgtcgagtcgacctgcaggatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcacaatggcggatagcccagtcatcaacctcagcaccatgtggaaacccctttcactgatggctttggaccttgccgttttgggacatgtctggaagcaggcacaacaggagggcagcatttcggcctatgctgattctgtttggactcctctcattatgtccggtttatacttatcaatgatcttcgtggggtgccgctggatgaagaaccgtgaaccctttgagatcaaaacatacatgtttgcgtataacctgtatcagaccttgatgaacctttgcatcgtgttgggattcttgtaccaggtgcatgccactgggatgcgcttttggggaagtggtgtcgaccgaagcccaaaaggtttgggcattggcttcttcatttatgcccactaccacaacaagtatgtggaatattttgatacactttttatggtgctgcgaaagaagaacaaccagatttctttccttcacgtgtatcatcatgccctgttgacatgggcttggtttgctgttgtgtatttcgcacctggaggtgatggctggtttggagcttgctacaattcttccatccatgtcctgatgtactcttactacttgcttgcaacttttggcatcagttgcccatggaagaagatcttgacacagctccagatggttcaattctgtttctgttttacacattccatttatgtgtggatttgcgggtcagagatctacccacggcctctgactgctttgcagtcgttcgtgatggtcaatatgttggtgctgtttggcaatttctatgtcaagcaatactcccaaaagaacggcaagccggagaacggagccacccctgagaacggagcgaagccgcaaccttgcgagaacggcacggtggaaaagcgagagaatgacaccgccaacgttcggcccgcccgtccagctggactcccgccggccacgtactacgactccctggcagtgtcggggcagggcaaggagcggctgttcaccaccgatgaggtgaggcggcacatcctccccaccgatggctggctgacgtgccacgaaggagtctacgatgtcactgatttccttgccaagcaccctggtggcggtgtcatcacgctgggccttggaagggactgcacaatcctcgtcgagtcataccaccctgctgggcgcccggacaaggtgatggagaagtaccgcattggtacgctgcaggaccccaagacgttctatgcttggggagagtccgatttctaccctgagttgaagcgccgggcccttgcaaggctgaaggaggctggtcaggcgcggcgcggcggccttggggtgaaggccctcctggtgctcaccctcttcttcgtgtcgtggtacatgtgggtggcccacaagtccttcctctgggccgccgtctggggcttcgccggctcccacgtcgggctgagcatccagcacgacggcaaccacggcgcgttcagccgcagcacactggtgaaccgcctggcggggtggggcatggacttgatcggcgcgtcgtcaacggtgtgggagtaccagcacgtcatcggccaccaccagtacaccaacctcgtgtcggacacgctattcagtctgcctgagaacgatccggacgtcttctccagctacccgctgatgcgcatgcacccggatacggcgtggcagccgcaccaccgcttccagcacctgttcgcgttcccactgttcgccctgatgacaatcagcaaggtgctgaccagcgatttcgctgtctgcctcagcatgaagaaggggtccatcgactgctcctccaggctcgtcccactggaggggcagctgctgttctggggggccaagctggcgaacttcctgttgcagattgtgttgccatgctacctccacgggacagctatgggcctggccctcttctctgttgcccaccttgtgtcgggggagtacctcgcgatctgcttcatcatcaaccacatcagcgagtcttgtgagtttatgaatacaagctttcaaaccgccgcccggaggacagagatgcttcaggcagcccatcaggcagcggaggccaagaaggtgaagcccacccctccaccgaacgattgggctgtgacacaggtccaatgctgcgtgaattggagatcaggtggcgtgttggccaatcacctctctggaggcttgaaccaccagatcgagcatcatctgttccccagcatctcgcatgccaactaccccatcatcgcccgtgttgtgaaggaggtgtgcgaggagtatgggttgccgtacaagaactacgtcacgttctgggatgcagtctgtggcatggttcagcacctccggttgatgggtgctccaccggtgccaacgaacggggacaaaaagtcataagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacctgca

SEQ ID NO: 133 - DNA, 8503 bp, Artificial Sequence
  plasmid pZBL119
gatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttgttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaatttcatatagtgttaaataataatttgttaaataaccaaaaagtcaaatatgtttactctcgtttaaataattgagattcgtccagcaaggctaaacgattgtatagatttatgacaatatttacttttttatagataaatgttatattataataaatttatatacatatattatatgttatttattattattttaaatccttcaatattttatcaaaccaactcataattttttttttatctgtaagaagcaataaaattaaatagacccactttaaggatgatccaacctttatacagagtaagagagttcaaatagtaccctttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaggttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatacttgcggccgcttactgcgccttacccatcttggaggcagccttggagacctcgttcagacggctaaagacctctgcagttccctcgatcataccggtggtgtggtatcggacattgtactttttgcacagggtctcgacagcaggctggatctttgaaaagttgtggcgaggcatcgaagggaacaagtggtgctcgatctgatagttcaatccacccgtgaaccagttggcaaatagacccgggtggacatcacgacccgtgatgatctgcttcgtgaagaaatccatatcgaccgcctcctccttcgagatcacaggcataccgttgtggttgagcgagaacacgatcgccaacaagtttccgcacaccgcctgcgacaccaaaaagtacaccagcatgttgacgggatccttgatgaacaggaacatggtggcgaggtaccaggtccagtgcatcgcaagcgacagctgctcgaccaacgagatgggcacacgcgcgcccgagggcttgtgggcctgaccgttaggcagcacaaagagaatggactggaggcaccaggagagacgggcaaacgagagaatggggaagtaaaaccaggtctggttcaggaccatgaaacgcgaccacatgcgggtcagctcctcatctgggacatccgagaacatctccaacgcatgctcactccaggtcaacagagggtgggtgtcaatgtcgggatcctcgccgtggacgttgggggcggcgtggtgagtgttgtgcttgtccttccaccacgaggacgagaagccctggcagacacctcccaagaaggcgccgaaaagatcaccccagaaacggtcctggaagacctggtgatgcaaaaagtcgtgagccaaccatccgcactgctgccagaacagacccaaaagcgcagccgagagcacgttggcgagggtcgaggtctggccccacttggccacaatgaccgtcgacaaaccccagatgcagaggttgaacgagaccttgaaggcgtagtatgccttggaagaatcgtagtaaccaagagactggaacaaggtacgcagcttgcggacctcggccgcaaagtcatcattcttgatatcgcggtcgctctcgtcaatatcaccaacgtaaaagttggcaagagtctcccaagcagcctcggggtgaaaagtgtcaaagacgtcagtgccgtccttgccaacgtgcgtgagaatcacacttccaccgggatgatcagggacgaactcgcggacatcgtacaccttgttgtcgatgatcatcaagaagggtgcctcggcatccttcttgccctcattcagagcctcggcattcaaaacctcggcccgagtaaacgtcctcacactgggagcagcagccatgcggccgcggtgatgactgatgagtgtttaaggaccaatggagagaatgtttgagttgtgaagcggagaacctgaggcgtggttatttatagggaagagaggaaggtgaatgagggacacgtcacagaagtagggtgctgagcttgagacattcttcagtatgcatggctatggaagccttgggtgctacacctcatgaagttcatggtgtgaggtggcttcggcatctcaattaagtgacaaagagaaaggtgtttcagtgtttctattgcaaatggcagaaactcgtgatgacgaggggaccatgcatggtttcatttcttttcttcctggattctttctttccttttatatatgcaggttcataatttaaaaattagactcgctttcaatttcttaatttctcattttcctcttatattactgtactaatgttaaccacgtacacttattttttttttagtttaattttgatagattgtgttgatttaaacatattaatattttcaaccaaataaaaatcattttagtagatacggctttttaaataattattaaaaatattaactatttatcctaaatggcacattttaattaaaaaaaatccggtgttgtaagtgttttattaatttgttttggcattattaaagcaactttttttttatttgttggcattttgagtacgtacttaggctag

SEQ ID NO: 134 - DNA, 21 bp, Artificial Sequence
  primer oSGly-2
aagcggccgcggtgatgactg

SEQ ID NO: 135 - DNA, 32 bp, Artificial Sequence
  primer oSGly-3
taagcttcgtacgctagcctaagtacgtactc

SEQ ID NO: 136 - DNA, 3673 bp, Artificial Sequence
  plasmid pPSgly32
gggctagagcggccgccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcagcccgggggatccgccctaagcttcgtacgctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgcggccgctt

SEQ ID NO: 137 - DNA, 4509 bp, Artificial Sequence
  plasmid pKR142
gtacgtcgagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccggggatcctctagacgtacgtgaaggttaaacatggtgaatatgttaccactagctgggatgcccattagatcaaaactgtaaaattctcccgtttcccttctattcacatgtgagccccctcccttttctttctttctcaattttgattgagttaaagtcaccagcaatgcatcactcaccctccaaaaaatttcttgtacaacttctcggactatcccaaagctccttttcctgagatggatggtcctgtctcttgcccttgatgtcttccttgttcgattttggcttcctctaatgtctttcttgctaggaatcaccacctcactcatctatgttgtcgtagcttctgaaagtctcatacatatccttagtgttgcactcatcttgtattgaagtgaaaaagaatgttgttctcctatccaaatctccattgaatctctttctcccaatgttgtcccatcggttggtcctcctctccaaccaattgtaaggtgtttaacataaacatggtacaattaagatttttcatttcattaagaaaagattgagatttgtggttctaaagtttcaattagagtttgatgatattgaaacaaccgtagaacacattaagtattactaacttatacatagagcattggaatttcaccttttatttattctgtttccgccaaaggtacatgactcaagttattttacacaagtaacaaaggcatctaagcctaagtattcttattcagacttttcattattactttcattgatttggtgcgaaatgcggccgcagttggatagaatatatgtttgtgacgcgaagaaccttaatctggcatagggatttatagtgaaacataggaaagtataggagggacacatcggctccaagaagatacatgagttgctgaccattcgacattcttcatcttgcatggttatggaagccttgtgtgttacacctcataaaatcaaatgtctcattacagcagaggtggcttcaagtgagagttgagtaattagatagctagctgaaatcggtggtgttggggaccatgtatagtatataattgatttctctttttacatatgtacgtgagtttgatcattactgtcttgtaatatctagatatatgaacctgattcactttcaagctagttaatgtctgtatattgtatgttggataggatttagttcatggtctgtacaaatttttaaagtttaatggtaaagcacaattttgtgtagttgaatataggtggacgataacaacttcaaattaaagtgcttgaattacaatttacaatatagtcatatatgttatataaaatcacacaaattatttggatcaataacaattgatttgctttaaatttgatgatgattgtttaagttctttaatacttatttaagaaaagttagccatcacattcgtaatcataacccttacttgactattttctttttaaattgatttgggaccgcttccgtaatcataatccttaattgatcattactttttaaactgatttgcaatgctagtgattacgaacttgaagtcaataaaataaaataaaatccatactatatattatgtgaacaaatcttgaatgaaaagtaaactagactaccattaagaaggaattactcgtcataatatttgtattgggacatttttgctcttatctaactagttccaaagttattgtgtttacatatcatcgtacaacgctcagacacttagttgaattaaggagagtcaaaacctatttgttaatatgagttatttttctttaaaactttgacctggagatcaaagataagaagggac

SEQ ID NO: 138 - DNA, 4171 bp, Artificial Sequence
  plasmid pKR264
gcccgggggatccgccctaagcttcgtacgctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgcggccgcatttcgcaccaaatcaatgaaagtaataatgaaaagtctgaataagaatacttaggcttagatgcctttgttacttgtgtaaaataacttgagtcatgtacctttggcggaaacagaataaataaaaggtgaaattccaatgctctatgtataagttagtaatacttaatgtgttctacggttgtttcaatatcatcaaactctaattgaaactttagaaccacaaatctcaatcttttcttaatgaaatgaaaaatcttaattgtaccatgtttatgttaaacaccttacaattggttggagaggaggaccaaccgatgggacaacattgggagaaagagattcaatggagatttggataggagaacaacattctttttcacttcaatacaagatgagtgcaacactaaggatatgtatgagactttcagaagctacgacaacatagatgagtgaggtggtgattcctagcaagaaagacattagaggaagccaaaatcgaacaaggaagacatcaagggcaagagacaggaccatccatctcaggaaaaggagctttgggatagtccgagaagttgtacaagaaattttttggagggtgagtgatgcattgctggtgactttaactcaatcaaaattgagaaagaaagaaaagggagggggctcacatgtgaatagaagggaaacgggagaattttacagttttgatctaatgggcatcccagctagtggtaacatattcaccatgtttaaccttcacgtacgtctagaggatccccgggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgca

SEQ ID NO: 139 - DNA, 6564 bp, Artificial Sequence
  plasmid pKR1128
ggccgcatttcgcaccaaatcaatgaaagtaataatgaaaagtctgaataagaatacttaggcttagatgcctttgttacttgtgtaaaataacttgagtcatgtacctttggcggaaacagaataaataaaaggtgaaattccaatgctctatgtataagttagtaatacttaatgtgttctacggttgtttcaatatcatcaaactctaattgaaactttagaaccacaaatctcaatcttttcttaatgaaatgaaaaatcttaattgtaccatgtttatgttaaacaccttacaattggttggagaggaggaccaaccgatgggacaacattgggagaaagagattcaatggagatttggataggagaacaacattctttttcacttcaatacaagatgagtgcaacactaaggatatgtatgagactttcagaagctacgacaacatagatgagtgaggtggtgattcctagcaagaaagacattagaggaagccaaaatcgaacaaggaagacatcaagggcaagagacaggaccatccatctcaggaaaaggagctttgggatagtccgagaagttgtacaagaaattttttggagggtgagtgatgcattgctggtgactttaactcaatcaaaattgagaaagaaagaaaagggagggggctcacatgtgaatagaagggaaacgggagaattttacagttttgatctaatgggcatcccagctagtggtaacatattcaccatgtttaaccttcacgtacgtctagaggatccccgggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcagcccgggggatccgccctaagcttcgtacgctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgcggccgcacaatggcggatagcccagtcatcaacctcagcaccatgtggaaacccctttcactgatggctttggaccttgccgttttgggacatgtctggaagcaggcacaacaggagggcagcatttcggcctatgctgattctgtttggactcctctcattatgtccggtttatacttatcaatgatcttcgtggggtgccgctggatgaagaaccgtgaaccctttgagatcaaaacatacatgtttgcgtataacctgtatcagaccttgatgaacctttgcatcgtgttgggattcttgtaccaggtgcatgccactgggatgcgcttttggggaagtggtgtcgaccgaagcccaaaaggtttgggcattggcttcttcatttatgcccactaccacaacaagtatgtggaatattttgatacactttttatggtgctgcgaaagaagaacaaccagatttctttccttcacgtgtatcatcatgccctgttgacatgggcttggtttgctgttgtgtatttcgcacctggaggtgatggctggtttggagcttgctacaattcttccatccatgtcctgatgtactcttactacttgcttgcaacttttggcatcagttgcccatggaagaagatcttgacacagctccagatggttcaattctgtttctgttttacacattccatttatgtgtggatttgcgggtcagagatctacccacggcctctgactgctttgcagtcgttcgtgatggtcaatatgttggtgctgtttggcaatttctatgtcaagcaatactcccaaaagaacggcaagccggagaacggagccacccctgagaacggagcgaagccgcaaccttgcgagaacggcacggtggaaaagcgagagaatgacaccgccaacgttcggcccgcccgtccagctggactcccgccggccacgtactacgactccctggcagtgtcggggcagggcaaggagcggctgttcaccaccgatgaggtgaggcggcacatcctccccaccgatggctggctgacgtgccacgaaggagtctacgatgtcactgatttccttgccaagcaccctggtggcggtgtcatcacgctgggccttggaagggactgcacaatcctcgtcgagtcataccaccctgctgggcgcccggacaaggtgatggagaagtaccgcattggtacgctgcaggaccccaagacgttctatgcttggggagagtccgatttctaccctgagttgaagcgccgggcccttgcaaggctgaaggaggctggtcaggcgcggcgcggcggccttggggtgaaggccctcctggtgctcaccctcttcttcgtgtcgtggtacatgtgggtggcccacaagtccttcctctgggccgccgtctggggcttcgccggctcccacgtcgggctgagcatccagcacgacggcaaccacggcgcgttcagccgcagcacactggtgaaccgcctggcggggtggggcatggacttgatcggcgcgtcgtcaacggtgtgggagtaccagcacgtcatcggccaccaccagtacaccaacctcgtgtcggacacgctattcagtctgcctgagaacgatccggacgtcttctccagctacccgctgatgcgcatgcacccggatacggcgtggcagccgcaccaccgcttccagcacctgttcgcgttcccactgttcgccctgatgacaatcagcaaggtgctgaccagcgatttcgctgtctgcctcagcatgaagaaggggtccatcgactgctcctccaggctcgtcccactggaggggcagctgctgttctggggggccaagctggcgaacttcctgttgcagattgtgttgccatgctacctccacgggacagctatgggcctggccctcttctctgttgcccaccttgtgtcgggggagtacctcgcgatctgcttcatcatcaaccacatcagcgagtcttgtgagtttatgaatacaagctttcaaaccgccgcccggaggacagagatgcttcaggcagcccatcaggcagcggaggccaagaaggtgaagcccacccctccaccgaacgattgggctgtgacacaggtccaatgctgcgtgaattggagatcaggtggcgtgttggccaatcacctctctggaggcttgaaccaccagatcgagcatcatctgttccccagcatctcgcatgccaactaccccatcatcgcccgtgttgtgaaggaggtgtgcgaggagtatgggttgccgtacaagaactacgtcacgttctgggatgcagtctgtggcatggttcagcacctccggttgatgggtgctccaccggtgccaacgaacggggacaaaaagtcataagc

SEQ ID NO: 140 - DNA, 5671 bp, Artificial Sequence
  plasmid KS129
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcatgggaacggaccaaggaaaaaccttcacctgggaagagctggcggcccataacaccaaggacgacctactcttggccatccgcggcagggtgtacgatgtcacaaagttcttgagccgccatcctggtggagtggacactctcctgctcggagctggccgagatgttactccggtctttgagatgtatcacgcgtttggggctgcagatgccattatgaagaagtactatgtcggtacactggtctcgaatgagctgcccatcttcccggagccaacggtgttccacaaaaccatcaagacgagagtcgagggctactttacggatcggaacattgatcccaagaatagaccagagatctggggacgatacgctcttatctttggatccttgatcgcttcctactacgcgcagctctttgtgcctttcgttgtcgaacgcacatggcttcaggtggtgtttgcaatcatcatgggatttgcgtgcgcacaagtcggactcaaccctcttcatgatgcgtctcacttttcagtgacccacaaccccactgtctggaagattctgggagccacgcacgactttttcaacggagcatcgtacctggtgtggatgtaccaacatatgctcggccatcacccctacaccaacattgctggagcagatcccgacgtgtcgacgtctgagcccgatgttcgtcgtatcaagcccaaccaaaagtggtttgtcaaccacatcaaccagcacatgtttgttcctttcctgtacggactgctggcgttcaaggtgcgcattcaggacatcaacattttgtactttgtcaagaccaatgacgctattcgtgtcaatcccatctcgacatggcacactgtgatgttctggggcggcaaggctttctttgtctggtatcgcctgattgttcccctgcagtatctgcccctgggcaaggtgctgctcttgttcacggtcgcggacatggtgtcgtcttactggctggcgctgaccttccaggcgaaccacgttgttgaggaagttcagtggccgttgcctgacgagaacgggatcatccaaaaggactgggcagctatgcaggtcgagactacgcaggattacgcacacgattcgcacctctggaccagcatcactggcagcttgaactaccaggctgtgcaccatctgttccccaacgtgtcgcagcaccattatcccgatattctggccatcatcaagaacacctgcagcgagtacaaggttccataccttgtcaaggatacgttttggcaagcatttgcttcacatttggagcacttgcgtgttcttggactccgtcccaaggaagagtaggc

SEQ ID NO: 141 - DNA, 6601 bp, Artificial Sequence
  plasmid pKR606
  misc_feature (5689)..(5689): n is a, c, g, or t
ggccgcatgggaacggaccaaggaaaaaccttcacctgggaagagctggcggcccataacaccaaggacgacctactcttggccatccgcggcagggtgtacgatgtcacaaagttcttgagccgccatcctggtggagtggacactctcctgctcggagctggccgagatgttactccggtctttgagatgtatcacgcgtttggggctgcagatgccattatgaagaagtactatgtcggtacactggtctcgaatgagctgcccatcttcccggagccaacggtgttccacaaaaccatcaagacgagagtcgagggctactttacggatcggaacattgatcccaagaatagaccagagatctggggacgatacgctcttatctttggatccttgatcgcttcctactacgcgcagctctttgtgcctttcgttgtcgaacgcacatggcttcaggtggtgtttgcaatcatcatgggatttgcgtgcgcacaagtcggactcaaccctcttcatgatgcgtctcacttttcagtgacccacaaccccactgtctggaagattctgggagccacgcacgactttttcaacggagcatcgtacctggtgtggatgtaccaacatatgctcggccatcacccctacaccaacattgctggagcagatcccgacgtgtcgacgtctgagcccgatgttcgtcgtatcaagcccaaccaaaagtggtttgtcaaccacatcaaccagcacatgtttgttcctttcctgtacggactgctggcgttcaaggtgcgcattcaggacatcaacattttgtactttgtcaagaccaatgacgctattcgtgtcaatcccatctcgacatggcacactgtgatgttctggggcggcaaggctttctttgtctggtatcgcctgattgttcccctgcagtatctgcccctgggcaaggtgctgctcttgttcacggtcgcggacatggtgtcgtcttactggctggcgctgaccttccaggcgaaccacgttgttgaggaagttcagtggccgttgcctgacgagaacgggatcatccaaaaggactgggcagctatgcaggtcgagactacgcaggattacgcacacgattcgcacctctggaccagcatcactggcagcttgaactaccaggctgtgcaccatctgttccccaacgtgtcgcagcaccattatcccgatattctggccatcatcaagaacacctgcagcgagtacaaggttccataccttgtcaaggatacgttttggcaagcatttgcttcacatttggagcacttgcgtgttcttggactccgtcccaaggaagagtaggcggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccggtctagaggatccaaggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgcgtacgtgggcggatcccccgggctgcaggaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactcgacgtacgtcctcgaagagaagggttaataacacattttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagc

SEQ ID NO: 142 - DNA, 6494 bp, Artificial Sequence
  plasmid pKR804
  misc_feature (3761)..(3761): n is a, c, g, or t
ccggccggatctcgtacggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttggatctcctgcaggatctggccgggtacgtcctcgaagagaagggttaataacacattttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggccgcatgggaacggaccaaggaaaaaccttcacctgggaagagctggcggcccataacaccaaggacgacctactcttggccatccgcggcagggtgtacgatgtcacaaagttcttgagccgccatcctggtggagtggacactctcctgctcggagctggccgagatgttactccggtctttgagatgtatcacgcgtttggggctgcagatgccattatgaagaagtactatgtcggtacactggtctcgaatgagctgcccatcttcccggagccaacggtgttccacaaaaccatcaagacgagagtcgagggctactttacggatcggaacattgatcccaagaatagaccagagatctggggacgatacgctcttatctttggatccttgatcgcttcctactacgcgcagctctttgtgcctttcgttgtcgaacgcacatggcttcaggtggtgtttgcaatcatcatgggatttgcgtgcgcacaagtcggactcaaccctcttcatgatgcgtctcacttttcagtgacccacaaccccactgtctggaagattctgggagccacgcacgactttttcaacggagcatcgtacctggtgtggatgtaccaacatatgctcggccatcacccctacaccaacattgctggagcagatcccgacgtgtcgacgtctgagcccgatgttcgtcgtatcaagcccaaccaaaagtggtttgtcaaccacatcaaccagcacatgtttgttcctttcctgtacggactgctggcgttcaaggtgcgcattcaggacatcaacattttgtactttgtcaagaccaatgacgctattcgtgtcaatcccatctcgacatggcacactgtgatgttctggggcggcaaggctttctttgtctggtatcgcctgattgttcccctgcagtatctgcccctgggcaaggtgctgctcttgttcacggtcgcggacatggtgtcgtcttactggctggcgctgaccttccaggcgaaccacgttgttgaggaagttcagtggccgttgcctgacgagaacgggatcatccaaaaggactgggcagctatgcaggtcgagactacgcaggattacgcacacgattcgcacctctggaccagcatcactggcagcttgaactaccaggctgtgcaccatctgttccccaacgtgtcgcagcaccattatcccgatattctggccatcatcaagaacacctgcagcgagtacaaggttccataccttgtcaaggatacgttttggcaagcatttgcttcacatttggagcacttgcgtgttcttggactccgtcccaaggaagagtaggcggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccggtctagaggatccaaggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgcgtac

SEQ ID NO: 143 - DNA, 10349 bp, Artificial Sequence
  plasmid pKR1130
  misc_feature (3748)..(3748): n is a, c, g, or t
gtacggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttggatctcctgcaggatctggccgggtacgtcctcgaagagaagggttaataacacattttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggccgcatgggaacggaccaaggaaaaaccttcacctgggaagagctggcggcccataacaccaaggacgacctactcttggccatccgcggcagggtgtacgatgtcacaaagttcttgagccgccatcctggtggagtggacactctcctgctcggagctggccgagatgttactccggtctttgagatgtatcacgcgtttggggctgcagatgccattatgaagaagtactatgtcggtacactggtctcgaatgagctgcccatcttcccggagccaacggtgttccacaaaaccatcaagacgagagtcgagggctactttacggatcggaacattgatcccaagaatagaccagagatctggggacgatacgctcttatctttggatccttgatcgcttcctactacgcgcagctctttgtgcctttcgttgtcgaacgcacatggcttcaggtggtgtttgcaatcatcatgggatttgcgtgcgcacaagtcggactcaaccctcttcatgatgcgtctcacttttcagtgacccacaaccccactgtctggaagattctgggagccacgcacgactttttcaacggagcatcgtacctggtgtggatgtaccaacatatgctcggccatcacccctacaccaacattgctggagcagatcccgacgtgtcgacgtctgagcccgatgttcgtcgtatcaagcccaaccaaaagtggtttgtcaaccacatcaaccagcacatgtttgttcctttcctgtacggactgctggcgttcaaggtgcgcattcaggacatcaacattttgtactttgtcaagaccaatgacgctattcgtgtcaatcccatctcgacatggcacactgtgatgttctggggcggcaaggctttctttgtctggtatcgcctgattgttcccctgcagtatctgcccctgggcaaggtgctgctcttgttcacggtcgcggacatggtgtcgtcttactggctggcgctgaccttccaggcgaaccacgttgttgaggaagttcagtggccgttgcctgacgagaacgggatcatccaaaaggactgggcagctatgcaggtcgagactacgcaggattacgcacacgattcgcacctctggaccagcatcactggcagcttgaactaccaggctgtgcaccatctgttccccaacgtgtcgcagcaccattatcccgatattctggccatcatcaagaacacctgcagcgagtacaaggttccataccttgtcaaggatacgttttggcaagcatttgcttcacatttggagcacttgcgtgttcttggactccgtcccaaggaagagtaggcggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccggtctagaggatccaaggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgcgtacccggccggatctcgtacgctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgcggccgcacaatggcggatagcccagtcatcaacctcagcaccatgtggaaacccctttcactgatggctttggaccttgccgttttgggacatgtctggaagcaggcacaacaggagggcagcatttcggcctatgctgattctgtttggactcctctcattatgtccggtttatacttatcaatgatcttcgtggggtgccgctggatgaagaaccgtgaaccctttgagatcaaaacatacatgtttgcgtataacctgtatcagaccttgatgaacctttgcatcgtgttgggattcttgtaccaggtgcatgccactgggatgcgcttttggggaagtggtgtcgaccgaagcccaaaaggtttgggcattggcttcttcatttatgcccactaccacaacaagtatgtggaatattttgatacactttttatggtgctgcgaaagaagaacaaccagatttctttccttcacgtgtatcatcatgccctgttgacatgggcttggtttgctgttgtgtatttcgcacctggaggtgatggctggtttggagcttgctacaattcttccatccatgtcctgatgtactcttactacttgcttgcaacttttggcatcagttgcccatggaagaagatcttgacacagctccagatggttcaattctgtttctgttttacacattccatttatgtgtggatttgcgggtcagagatctacccacggcctctgactgctttgcagtcgttcgtgatggtcaatatgttggtgctgtttggcaatttctatgtcaagcaatactcccaaaagaacggcaagccggagaacggagccacccctgagaacggagcgaagccgcaaccttgcgagaacggcacggtggaaaagcgagagaatgacaccgccaacgttcggcccgcccgtccagctggactcccgccggccacgtactacgactccctggcagtgtcggggcagggcaaggagcggctgttcaccaccgatgaggtgaggcggcacatcctccccaccgatggctggctgacgtgccacgaaggagtctacgatgtcactgatttccttgccaagcaccctggtggcggtgtcatcacgctgggccttggaagggactgcacaatcctcgtcgagtcataccaccctgctgggcgcccggacaaggtgatggagaagtaccgcattggtacgctgcaggaccccaagacgttctatgcttggggagagtccgatttctaccctgagttgaagcgccgggcccttgcaaggctgaaggaggctggtcaggcgcggcgcggcggccttggggtgaaggccctcctggtgctcaccctcttcttcgtgtcgtggtacatgtgggtggcccacaagtccttcctctgggccgccgtctggggcttcgccggctcccacgtcgggctgagcatccagcacgacggcaaccacggcgcgttcagccgcagcacactggtgaaccgcctggcggggtggggcatggacttgatcggcgcgtcgtcaacggtgtgggagtaccagcacgtcatcggccaccaccagtacaccaacctcgtgtcggacacgctattcagtctgcctgagaacgatccggacgtcttctccagctacccgctgatgcgcatgcacccggatacggcgtggcagccgcaccaccgcttccagcacctgttcgcgttcccactgttcgccctgatgacaatcagcaaggtgctgaccagcgatttcgctgtctgcctcagcatgaagaaggggtccatcgactgctcctccaggctcgtcccactggaggggcagctgctgttctggggggccaagctggcgaacttcctgttgcagattgtgttgccatgctacctccacgggacagctatgggcctggccctcttctctgttgcccaccttgtgtcgggggagtacctcgcgatctgcttcatcatcaaccacatcagcgagtcttgtgagtttatgaatacaagctttcaaaccgccgcccggaggacagagatgcttcaggcagcccatcaggcagcggaggccaagaaggtgaagcccacccctccaccgaacgattgggctgtgacacaggtccaatgctgcgtgaattggagatcaggtggcgtgttggccaatcacctctctggaggcttgaaccaccagatcgagcatcatctgttccccagcatctcgcatgccaactaccccatcatcgcccgtgttgtgaaggaggtgtgcgaggagtatgggttgccgtacaagaactacgtcacgttctgggatgcagtctgtggcatggttcagcacctccggttgatgggtgctccaccggtgccaacgaacggggacaaaaagtcataagcggccgcatttcgcaccaaatcaatgaaagtaataatgaaaagtctgaataagaatacttaggcttagatgcctttgttacttgtgtaaaataacttgagtcatgtacctttggcggaaacagaataaataaaaggtgaaattccaatgctctatgtataagttagtaatacttaatgtgttctacggttgtttcaatatcatcaaactctaattgaaactttagaaccacaaatctcaatcttttcttaatgaaatgaaaaatcttaattgtaccatgtttatgttaaacaccttacaattggttggagaggaggaccaaccgatgggacaacattgggagaaagagattcaatggagatttggataggagaacaacattctttttcacttcaatacaagatgagtgcaacactaaggatatgtatgagactttcagaagctacgacaacatagatgagtgaggtggtgattcctagcaagaaagacattagaggaagccaaaatcgaacaaggaagacatcaagggcaagagacaggaccatccatctcaggaaaaggagctttgggatagtccgagaagttgtacaagaaattttttggagggtgagtgatgcattgctggtgactttaactcaatcaaaattgagaaagaaagaaaagggagggggctcacatgtgaatagaagggaaacgggagaattttacagttttgatctaatgggcatcccagctagtggtaacatattcaccatgtttaaccttcac

SEQ ID NO: 144 - DNA, 4771 bp, Artificial Sequence
  plasmid pKR1131
aaacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccgggggcgcgccggatcctctagacctgcaggccaactgcgtttggggctccagattaaacgacgccgtttcgttcctttcgcttcacggcttaacgatgtcgtttctgtctgtgcccaaaaaataaaggcatttgttatttgcaccagatatttactaagtgcaccctagtttgacaagtaggcgataattacaaatagatgcggtgcaaataataaattttgaaggaaataattacaaaagaacagaacttatatttactttattttaaaaaactaaaatgaaagaacaaaaaaagtaaaaaatacaaaaaatgtgctttaaccactttcattatttgttacagaaagtatgattctactcaaattgatctgttgtatctggtgctgccttgtcacactggcgatttcaatcccctaaagatatggtgcaaactgcgaagtgatcaatatctgctcggttaatttagattaattaataatattcaacgtgatgtaccaaaaaaagacaattttttgctccattgacaaattaaacctcatcaaggtaatttccaaacctataagcaaaaaaatttcacattaattggcccgcaatcctattagtcttattatactagagtaggaaaaaaaacaattacacaacttgtcttattattctctatgctaatgaatatttttcccttttgttagaaatcagtgtttcctaatttattgagtattaattccactcaccgcatatatttaccgttgaataagaaaattttacacataattctttttaagataaataatttttttatactagatcttatatgattacgtgaagccaagtgggttatactaatgatatataatgtttgatagtaatcagtttataaaccaaatgcatggaaatgttacgtggaagcacgtaaattaacaagcattgaagcaaatgcagccaccgcaccaaaaccaccccacttcacttccacgtaccatattccatgcaactacaacaccctaaaacttcaataaatgcccccaccttcacttcacttcacccatcaatagcaagcggccgcaccatggaggtggtgaatgaaatagtctcaattgggcaggaagttttacccaaagttgattatgcccaactctggagtgatgccagtcactgtgaggtgctttacttgtccatcgcatttgtcatcttgaagttcactcttggcccccttggtccaaaaggtcagtctcgtatgaagtttgttttcaccaattacaaccttctcatgtccatttattcgttgggatcattcctctcaatggcatatgccatgtacaccatcggtgttatgtctgacaactgcgagaaggcttttgacaacaacgtcttcaggatcaccacgcagttgttctatttgagcaagttcctggagtatattgactccttctatttgccactgatgggcaagcctctgacctggttgcaattcttccatcatttgggggcaccgatggatatgtggctgttctataattaccgaaatgaagctgtttggatttttgtgctgttgaatggtttcatccactggatcatgtacggttattattggaccagattgatcaagctgaagttccccatgccaaaatccctgattacatcaatgcagatcattcaattcaatgttggtttctacattgtctggaagtacaggaacattccctgttatcgccaagatgggatgaggatgtttggctggttcttcaattacttttatgttggcacagtcttgtgtttgttcttgaatttctatgtgcaaacgtatatcgtcaggaagcacaagggagccaaaaagattcagtgagcggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgcgtac

SEQ ID NO: 145 - DNA, 12430 bp, Artificial Sequence
  plasmid pKR1133
  misc_feature (9154)..(9154): n is a, c, g, or t
ggagatccaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcagatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgtgaaggttaaacatggtgaatatgttaccactagctgggatgcccattagatcaaaactgtaaaattctcccgtttcccttctattcacatgtgagccccctcccttttctttctttctcaattttgattgagttaaagtcaccagcaatgcatcactcaccctccaaaaaatttcttgtacaacttctcggactatcccaaagctccttttcctgagatggatggtcctgtctcttgcccttgatgtcttccttgttcgattttggcttcctctaatgtctttcttgctaggaatcaccacctcactcatctatgttgtcgtagcttctgaaagtctcatacatatccttagtgttgcactcatcttgtattgaagtgaaaaagaatgttgttctcctatccaaatctccattgaatctctttctcccaatgttgtcccatcggttggtcctcctctccaaccaattgtaaggtgtttaacataaacatggtacaattaagatttttcatttcattaagaaaagattgagatttgtggttctaaagtttcaattagagtttgatgatattgaaacaaccgtagaacacattaagtattactaacttatacatagagcattggaatttcaccttttatttattctgtttccgccaaaggtacatgactcaagttattttacacaagtaacaaaggcatctaagcctaagtattcttattcagacttttcattattactttcattgatttggtgcgaaatgcggccgcttatgactttttgtccccgttcgttggcaccggtggagcacccatcaaccggaggtgctgaaccatgccacagactgcatcccagaacgtgacgtagttcttgtacggcaacccatactcctcgcacacctccttcacaacacgggcgatgatggggtagttggcatgcgagatgctggggaacagatgatgctcgatctggtggttcaagcctccagagaggtgattggccaacacgccacctgatctccaattcacgcagcattggacctgtgtcacagcccaatcgttcggtggaggggtgggcttcaccttcttggcctccgctgcctgatgggctgcctgaagcatctctgtcctccgggcggcggtttgaaagcttgtattcataaactcacaagactcgctgatgtggttgatgatgaagcagatcgcgaggtactcccccgacacaaggtgggcaacagagaagagggccaggcccatagctgtcccgtggaggtagcatggcaacacaatctgcaacaggaagttcgccagcttggccccccagaacagcagctgcccctccagtgggacgagcctggaggagcagtcgatggaccccttcttcatgctgaggcagacagcgaaatcgctggtcagcaccttgctgattgtcatcagggcgaacagtgggaacgcgaacaggtgctggaagcggtggtgcggctgccacgccgtatccgggtgcatgcgcatcagcgggtagctggagaagacgtccggatcgttctcaggcagactgaatagcgtgtccgacacgaggttggtgtactggtggtggccgatgacgtgctggtactcccacaccgttgacgacgcgccgatcaagtccatgccccaccccgccaggcggttcaccagtgtgctgcggctgaacgcgccgtggttgccgtcgtgctggatgctcagcccgacgtgggagccggcgaagccccagacggcggcccagaggaaggacttgtgggccacccacatgtaccacgacacgaagaagagggtgagcaccaggagggccttcaccccaaggccgccgcgccgcgcctgaccagcctccttcagccttgcaagggcccggcgcttcaactcagggtagaaatcggactctccccaagcatagaacgtcttggggtcctgcagcgtaccaatgcggtacttctccatcaccttgtccgggcgcccagcagggtggtatgactcgacgaggattgtgcagtcccttccaaggcccagcgtgatgacaccgccaccagggtgcttggcaaggaaatcagtgacatcgtagactccttcgtggcacgtcagccagccatcggtggggaggatgtgccgcctcacctcatcggtggtgaacagccgctccttgccctgccccgacactgccagggagtcgtagtacgtggccggcgggagtccagctggacgggcgggccgaacgttggcggtgtcattctctcgcttttccaccgtgccgttctcgcaaggttgcggcttcgctccgttctcaggggtggctccgttctccggcttgccgttcttttgggagtattgcttgacatagaaattgccaaacagcaccaacatattgaccatcacgaacgactgcaaagcagtcagaggccgtgggtagatctctgacccgcaaatccacacataaatggaatgtgtaaaacagaaacagaattgaaccatctggagctgtgtcaagatcttcttccatgggcaactgatgccaaaagttgcaagcaagtagtaagagtacatcaggacatggatggaagaattgtagcaagctccaaaccagccatcacctccaggtgcgaaatacacaacagcaaaccaagcccatgtcaacagggcatgatgatacacgtgaaggaaagaaatctggttgttcttctttcgcagcaccataaaaagtgtatcaaaatattccacatacttgttgtggtagtgggcataaatgaagaagccaatgcccaaaccttttgggcttcggtcgacaccacttccccaaaagcgcatcccagtggcatgcacctggtacaagaatcccaacacgatgcaaaggttcatcaaggtctgatacaggttatacgcaaacatgtatgttttgatctcaaagggttcacggttcttcatccagcggcaccccacgaagatcattgataagtataaaccggacataatgagaggagtccaaacagaatcagcataggccgaaatgctgccctcctgttgtgcctgcttccagacatgtcccaaaacggcaaggtccaaagccatcagtgaaaggggtttccacatggtgctgaggttgatgactgggctatccgccattgtgcggccgcggtgatgactgatgagtgtttaaggaccaatggagagaatgtttgagttgtgaagcggagaacctgaggcgtggttatttatagggaagagaggaaggtgaatgagggacacgtcacagaagtagggtgctgagcttgagacattcttcagtatgcatggctatggaagccttgggtgctacacctcatgaagttcatggtgtgaggtggcttcggcatctcaattaagtgacaaagagaaaggtgtttcagtgtttctattgcaaatggcagaaactcgtgatgacgaggggaccatgcatggtttcatttcttttcttcctggattctttctttccttttatatatgcaggttcataatttaaaaattagactcgctttcaatttcttaatttctcattttcctcttatattactgtactaatgttaaccacgtacacttattttttttttagtttaattttgatagattgtgttgatttaaacatattaatattttcaaccaaataaaaatcattttagtagatacggctttttaaataattattaaaaatattaactatttatcctaaatggcacattttaattaaaaaaaatccggtgttgtaagtgttttattaatttgttttggcattattaaagcaactttttttttatttgttggcattttgagtacgtacttaggctagcgtacgagatccggccgggtacgcaaaggcaaagatttaaactcgaaaacattacaaaagtctcaaaacagaggcaaggccatgcacaaagcacactctaagtgcttccattgcctactaagtagggtacgtacacgatcaccattcaccagtgatgatctttattaatatacaacacactcagagacagcttatgttatagctagctagcataaactatcacatcatgtgttagtacgacaagtgacaacattgcttttaacttcgcggccttggatcctctagaccggatataatgagccgtaaacaaagatgattaagtagtaattaatacgtactagtaaaagtggcaaaagataacgagaaagaaccaatttctttgcattcggccttagcggaaggcatatataagctttgattattttatttagtgtaatgatttcgtacaaccaaagcatttatttagtactctcacacttgtgtcgcggccgcctactcttccttgggacggagtccaagaacacgcaagtgctccaaatgtgaagcaaatgcttgccaaaacgtatccttgacaaggtatggaaccttgtactcgctgcaggtgttcttgatgatggccagaatatcgggataatggtgctgcgacacgttggggaacagatggtgcacagcctggtagttcaagctgccagtgatgctggtccagaggtgcgaatcgtgtgcgtaatcctgcgtagtctcgacctgcatagctgcccagtccttttggatgatcccgttctcgtcaggcaacggccactgaacttcctcaacaacgtggttcgcctggaaggtcagcgccagccagtaagacgacaccatgtccgcgaccgtgaacaagagcagcaccttgcccaggggcagatactgcaggggaacaatcaggcgataccagacaaagaaagccttgccgccccagaacatcacagtgtgccatgtcgagatgggattgacacgaatagcgtcattggtcttgacaaagtacaaaatgttgatgtcctgaatgcgcaccttgaacgccagcagtccgtacaggaaaggaacaaacatgtgctggttgatgtggttgacaaaccacttttggttgggcttgatacgacgaacatcgggctcagacgtcgacacgtcgggatctgctccagcaatgttggtgtaggggtgatggccgagcatatgttggtacatccacaccaggtacgatgctccgttgaaaaagtcgtgcgtggctcccagaatcttccagacagtggggttgtgggtcactgaaaagtgagacgcatcatgaagagggttgagtccgacttgtgcgcacgcaaatcccatgatgattgcaaacaccacctgaagccatgtgcgttcgacaacgaaaggcacaaagagctgcgcgtagtaggaagcgatcaaggatccaaagataagagcgtatcgtccccagatctctggtctattcttgggatcaatgttccgatccgtaaagtagccctcgactctcgtcttgatggttttgtggaacaccgttggctccgggaagatgggcagctcattcgagaccagtgtaccgacatagtacttcttcataatggcatctgcagccccaaacgcgtgatacatctcaaagaccggagtaacatctcggccagctccgagcaggagagtgtccactccaccaggatggcggctcaagaactttgtgacatcgtacaccctgccgcggatggccaagagtaggtcgtccttggtgttatgggccgccagctcttcccaggtgaaggtttttccttggtccgttcccatgcggccgcttggggggctatggaagactttcttagttagttgtgtgaataagcaatgttgggagaatcgggactacttataggataggaataaaacagaaaagtattaagtgctaatgaaatatttagactgataattaaaatcttcacgtatgtccacttgatataaaaacgtcaggaataaaggaagtacagtagaatttaaaggtactctttttatatatacccgtgttctctttttggctagctagttgcataaaaaataatctatatttttatcattattttaaatatcttatgagatggtaaatatttatcataattttttttactattatttattatttgtgtgtgtaatacatatagaagttaattacaaattttatttactttttcattattttgatatgattcaccattaatttagtgttattatttataatagttcattttaatctttttgtatatattatgcgtgcagtacttttttcctacatataactactattacattttatttatataatatttttattaatgaattttcgtgataatatgtaatattgttcattattatttcagattttttaaaaatatttgtgttattatttatgaaatatgtaatttttttagtatttgattttatgatgataaagtgttctaaattcaaaagaagggggaaagcgtaaacattaaaaaacgtcatcaaacaaaaacaaaatcttgttaataaagataaaactgtttgttttgatcactgttatttcgtaatataaaaacattatttatatttatattgttgacaaccaaatttgcctatcaaatctaaccaatataatgcatgcgtggcaggtaatgtactaccatgaacttaagtcatgacataataaaccgtgaatctgaccaatgcatgtacctanctaaattgtatttgtgacacgaagcaaatgattcaattcacaatggagatgggaaacaaataatgaagaacccagaactaagaaagcttttctgaaaaataaaataaaggcaatgtcaaaagtatactgcatcatcagtccagaaagcacatgatatttttttatcagtatcaatgcagctagttttattttacaatatcgatatagctagtttaaatatattgcagctagatttataaatatttgtgttattatttatcatttgtgtaatcctgtttttagtattttagtttatatatgatgataatgtattccaaatttaaaagaagggaaataaatttaaacaagaaaaaaagtcatcaaacaaaaaacaaatgaaagggtggaaagatgttaccatgtaatgtgaatgttacagtatttcttttattatagagttaacaaattaactaatatgattttgttaataatgataaaatattttttttattattatttcataatataaaaatagtttacttaatataaaaaaaattctatcgttcacaacaaagttggccacctaatttaaccatgcatgtacccatggaccatattaggtaaccatcaaacctgatgaagagataaagagatgaagacttaagtcataacacaaaaccataaaaaacaaaaatacaatcaaccgtcaatctgaccaatgcatgaaaaagctgcaatagtgagtggcgacacaaagcacatgattttcttacaacggagataaaaccaaaaaaatatttcatgaacaacctagaacaaataaagcttttatataataaatatataaataaataaaggctatggaataatatacttcaatatatttggattaaataaattgttggcggggttgatatatttatacacacctaaagtcacttcaatctcattttcacttaacttttattttttttttctttttatttatcataaagagaatattgataatatactttttaacatatttttatgacattttttattggtgaaaacttattaaaaatcataaattttgtaagttagatttatttaaagagttcctcttcttattttaaattttttaataaatttttaaataactaaaatttgtgttaaaaatgttaaaaaatgtgttattaacccttctcttcgaggacgtacccggccagatcctgcaggccaactgcgtttggggctccagattaaacgacgccgtttcgttcctttcgcttcacggcttaacgatgtcgtttctgtctgtgcccaaaaaataaaggcatttgttatttgcaccagatatttactaagtgcaccctagtttgacaagtaggcgataattacaaatagatgcggtgcaaataataaattttgaaggaaataattacaaaagaacagaacttatatttactttattttaaaaaactaaaatgaaagaacaaaaaaagtaaaaaatacaaaaaatgtgctttaaccactttcattatttgttacagaaagtatgattctactcaaattgatctgttgtatctggtgctgccttgtcacactggcgatttcaatcccctaaagatatggtgcaaactgcgaagtgatcaatatctgctcggttaatttagattaattaataatattcaacgtgatgtaccaaaaaaagacaattttttgctccattgacaaattaaacctcatcaaggtaatttccaaacctataagcaaaaaaatttcacattaattggcccgcaatcctattagtcttattatactagagtaggaaaaaaaacaattacacaacttgtcttattattctctatgctaatgaatatttttcccttttgttagaaatcagtgtttcctaatttattgagtattaattccactcaccgcatatatttaccgttgaataagaaaattttacacataattctttttaagataaataatttttttatactagatcttatatgattacgtgaagccaagtgggttatactaatgatatataatgtttgatagtaatcagtttataaaccaaatgcatggaaatgttacgtggaagcacgtaaattaacaagcattgaagcaaatgcagccaccgcaccaaaaccaccccacttcacttccacgtaccatattccatgcaactacaacaccctaaaacttcaataaatgcccccaccttcacttcacttcacccatcaatagcaagcggccgcaccatggaggtggtgaatgaaatagtctcaattgggcaggaagttttacccaaagttgattatgcccaactctggagtgatgccagtcactgtgaggtgctttacttgtccatcgcatttgtcatcttgaagttcactcttggcccccttggtccaaaaggtcagtctcgtatgaagtttgttttcaccaattacaaccttctcatgtccatttattcgttgggatcattcctctcaatggcatatgccatgtacaccatcggtgttatgtctgacaactgcgagaaggcttttgacaacaacgtcttcaggatcaccacgcagttgttctatttgagcaagttcctggagtatattgactccttctatttgccactgatgggcaagcctctgacctggttgcaattcttccatcatttgggggcaccgatggatatgtggctgttctataattaccgaaatgaagctgtttggatttttgtgctgttgaatggtttcatccactggatcatgtacggttattattggaccagattgatcaagctgaagttccccatgccaaaatccctgattacatcaatgcagatcattcaattcaatgttggtttctacattgtctggaagtacaggaacattccctgttatcgccaagatgggatgaggatgtttggctggttcttcaattacttttatgttggcacagtcttgtgtttgttcttgaatttctatgtgcaaacgtatatcgtcaggaagcacaagggagccaaaaagattcagtgagcggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgcgtacaaacctgca

SEQ ID NO: 146 - DNA, 7048 bp, Artificial Sequence
  plasmid pKS123
agcttggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatcgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaaca

SEQ ID NO: 147 - DNA, 29 bp, Artificial Sequence
  primer oKti5
atctagacgtacgtcctcgaagagaaggg

SEQ ID NO: 148 - DNA, 27 bp, Artificial Sequence
  primer oKti6
ttctagacgtacggatataatgagccg

SEQ ID NO: 149 - DNA, 4990 bp, Artificial Sequence
  plasmid pKR124
  misc_feature (1186)..(1186): n is a, c, g, or t
ctagacgtacgtcctcgaagagaagggttaataacacattttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccgtacgtcgagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccggggatcct

SEQ ID NO: 150 - DNA, 4474 bp, Artificial Sequence
  plasmid pKR193
gtacgtctagaggatccccgggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactcgacgtacgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaac

SEQ ID NO: 151 - DNA, 5397 bp, Artificial Sequence
  plasmid pKR1103
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacgtacgtctagaggatccccgggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactcgacgtacgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatggcggatagcccagtcatcaacctcagcaccatgtggaaacccctttcactgatggctttggaccttgccgttttgggacatgtctggaagcaggcacaacaggagggcagcatttcggcctatgctgattctgtttggactcctctcattatgtccggtttatacttatcaatgatcttcgtggggtgccgctggatgaagaaccgtgaaccctttgagatcaaaacatacatgtttgcgtataacctgtatcagaccttgatgaacctttgcatcgtgttgggattcttgtaccaggtgcatgccactgggatgcgcttttggggaagtggtgtcgaccgaagcccaaaaggtttgggcattggcttcttcatttatgcccactaccacaacaagtatgtggaatattttgatacactttttatggtgctgcgaaagaagaacaaccagatttctttccttcacgtgtatcatcatgccctgttgacatgggcttggtttgctgttgtgtatttcgcacctggaggtgatggctggtttggagcttgctacaattcttccatccatgtcctgatgtactcttactacttgcttgcaacttttggcatcagttgcccttggaagaagatcttgacacagctccagatggttcaattctgtttctgttttacacattccatttatgtgtggatttgcgggtcagagatctacccacggcctctgactgctttgcagtcgttcgtgatggtcaatatgttggtgctgtttggcaatttctatgtcaagcaatactcccaaaagaacggcaagccggagaacggagccacccctgagaacggagcgaagccgcaaccttgcgagaacggcacggtggaaaagcgagagaatgacaccgccaacgttcggtgagc

SEQ ID NO: 152 - DNA, 9226 bp, Artificial Sequence
  plasmid pKR1104
gtacgtctagaggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagctgggtctagaactagaaacgtgatgccacttgttattgaagtcgattacagcatctattctgttttactatttataactttgccatttctgacttttgaaaactatctctggatttcggtatcgctttgtgaagatcgagcaaaagagacgttttgtggacgcaatggtccaaatccgttctacatgaacaaattggtcacaatttccactaaaagtaaataaatggcaagttaaaaaaggaatatgcattttactgattgcctaggtgagctccaagagaagttgaatctacacgtctaccaaccgctaaaaaaagaaaaacattgaatatgtaacctgattccattagcttttgacttcttcaacagattctctacttagatttctaacagaaatattattactagcacatcattttcagtctcactacagcaaaaaatccaacggcacaatacagacaacaggagatatcagactacagagatagatagatgctactgcatgtagtaagttaaataaaaggaaaataaaatgtcttgctaccaaaactactacagactatgatgctcaccacaggccaaatcctgcaactaggacagcattatcttatatatattgtacaaaacaagcatcaaggaacatttggtctaggcaatcagtacctcgttctaccatcaccctcagttatcacatccttgaaggatccattactgggaatcatcggcaacacatgctcctgatggggcacaatgacatcaagaaggtaggggccaggggtgtccaacattctctgaattgccgctctaagctcttccttcttcgtcactcgcgctgccggtatcccacaagcatcagcaaacttgagcatgtttgggaatatctcgctctcgctagacggatctccaagataggtgtgagctctattggacttgtagaacctatcctccaactgaaccaccatacccaaatgctgattgttcaacaacaatatcttaactgggagattctccactcttatagtggccaactcctgaacattcatgatgaaactaccatccccatcaatgtcaaccacaacagccccagggttagcaacagcagcaccaatagccgcaggcaatccaaaacccatggctccaagaccccctgaggtcaaccactgcctcggtctcttgtacttgtaaaactgcgcagcccacatttgatgctgcccaaccccagtactaacaatagcatctccattagtcaactcatcaagaacctcgatagcatgctgcggagaaatcgcgtcctggaatgtcttgtaacccaatggaaacttgtgtttctgcacattaatctcttctctccaacctccaagatcaaacttaccctccactcctttctcctccaaaatcatattaattcccttcaaggccaacttcaaatccgcgcaaaccgacacgtgcgcctgcttgttcttcccaatctcggcagaatcaatatcaatgtgaacaatcttagccctactagcaaaagcctcaagcttcccagtaacacggtcatcaaaccttaccccaaaggcaagcaacaaatcactattgtcaacagcatagttagcataaacagtaccatgcatacccagcatctgaagggaatattcatcaccaataggaaaagttccaagacccattaaagtgctagcaacgggaataccagtgagttcaacaaagcgcctcaattcagcactggaattcaaactgccaccgccgacgtagagaacgggcttttgggcctccatgatgagtctgacaatgtgttccaattgggcctcggcggggggcctgggcagcctggcgaggtaaccggggaggttaacgggctcgtcccaattaggcacggcgagttgctgctgaacgtctttgggaatgtcgatgaggaccggaccggggcggccggaggtggcgacgaagaaagcctcggcgacgacgcgggggatgtcgtcgacgtcgaggatgaggtagttgtgcttcgtgatggatctgctcacctccacgatcggggtttcttggaaggcgtcggtgccgatcatccggcgggcgacctggccggtgatggcgacgactgggacgctgtccattaaagcgtcggcgaggccgctcacgaggttggtggcgccggggccggaggtggcaatgcagacgccggggaggccggaggaacgcgcgtagccttcggcggcgaagacgccgccctgctcgtggcgcgggagcacgttgcggatggcggcggagcgcgtgagcgcctggtggatctccatcgacgcaccgccggggtacgcgaacaccgtcgtcacgccctgcctctccagcgcctccacaaggatgtccgcgcccttgcgaggttcgccggaggcgaaccgtgacacgaagggctccgtggtcggcgcttccttggtgaagggcgccgccgtggggggtttggagatggaacatttgattttgagagcgtggttgggtttggtgagggtttgatgagagagagggagggtggatctagtaatgcgtttggggaaggtggggtgtgaagaggaagaagagaatcgggtggttctggaagcggtggccgccattgtgttgtgtggcatggttatacttcaaaaactgcacaacaagcctagagttagtacctaaacagtaaatttacaacagagagcaaagacacatgcaaaaatttcagccataaaaaaagttataatagaatttaaagcaaaagtttcattttttaaacatatatacaaacaaactggatttgaaggaagggattaattcccctgctcaaagtttgaattcctattgtgacctatactcgaataaaattgaagcctaaggaatgtatgagaaacaagaaaacaaaacaaaactacagacaaacaagtacaattacaaaattcgctaaaattctgtaatcaccaaaccccatctcagtcagcacaaggcccaaggtttattttgaaataaaaaaaaagtgattttatttctcataagctaaaagaaagaaaggcaattatgaaatgatttcgactagatctgaaagtcaaacgcgtattccgcagatattaaagaaagagtagagtttcacatggatcctagatggacccagttgaggaaaaagcaaggcaaagcaaaccagaagtgcaagatccgaaattgaaccacggaatctaggatttggtagagggagaagaaaagtaccttgagaggtagaagagaagagaagagcagagagatatatgaacgagtgtgtcttggtctcaactctgaagcgatacgagtttagaggggagcattgagttccaatttatagggaaaccgggtggcaggggtgagttaatgacggaaaagcccctaagtaacgagattggattgtgggttagattcaaccgtttgcatccgcggcttagattggggaagtcagagtgaatctcaaccgttgactgagttgaaaattgaatgtagcaaccaattgagccaaccccagcctttgccctttgattttgatttgtttgttgcatactttttatttgtcttctggttctgactctctttctctcgtttcaatgccaggttgcctactcccacaccactcacaagaagattctactgttagtattaaatattttttaatgtattaaatgatgaatgcttttgtaaacagaacaagactatgtctaataagtgtcttgcaacattttttaagaaattaaaaaaaatatatttattatcaaaatcaaatgtatgaaaaatcatgaataatataattttatacatttttttaaaaaatcttttaatttcttaattaatatcttaaaaataatgattaatatttaacccaaaataattagtatgattggtaaggaagatatccatgttatgtttggatgtgagtttgatctagagcaaagcttactagagtcgacctgcaggtcgactcgacgtacgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatggcggatagcccagtcatcaacctcagcaccatgtggaaacccctttcactgatggctttggaccttgccgttttgggacatgtctggaagcaggcacaacaggagggcagcatttcggcctatgctgattctgtttggactcctctcattatgtccggtttatacttatcaatgatcttcgtggggtgccgctggatgaagaaccgtgaaccctttgagatcaaaacatacatgtttgcgtataacctgtatcagaccttgatgaacctttgcatcgtgttgggattcttgtaccaggtgcatgccactgggatgcgcttttggggaagtggtgtcgaccgaagcccaaaaggtttgggcattggcttcttcatttatgcccactaccacaacaagtatgtggaatattttgatacactttttatggtgctgcgaaagaagaacaaccagatttctttccttcacgtgtatcatcatgccctgttgacatgggcttggtttgctgttgtgtatttcgcacctggaggtgatggctggtttggagcttgctacaattcttccatccatgtcctgatgtactcttactacttgcttgcaacttttggcatcagttgcccttggaagaagatcttgacacagctccagatggttcaattctgtttctgttttacacattccatttatgtgtggatttgcgggtcagagatctacccacggcctctgactgctttgcagtcgttcgtgatggtcaatatgttggtgctgtttggcaatttctatgtcaagcaatactcccaaaagaacggcaagccggagaacggagccacccctgagaacggagcgaagccgcaaccttgcgagaacggcacggtggaaaagcgagagaatgacaccgccaacgttcggtgagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaac

SEQ ID NO: 153 - DNA, 8649 bp, Artificial Sequence
  plasmid pKR300
aattcatgacggtgggcggcgatgaggtgtacagcatggcgcaggtgcgcgaccacaacaccccggacgacgcctggtgcgccatccacggcgaggtgtacgagctgaccaagttcgcccgcacccaccccgggggggacatcatcttgctggccgccggcaaggaggccaccatcctgttcgagacgtaccacgtgcgccccatctccgacgcggtcctgcgcaagtaccgcatcggcaagctcgccgccgccggcaaggatgagccggccaacgacagcacctactacagctgggacagcgacttttacaaggtgctccgccagcgtgtcgtggcgcgcctcgaggagcgcaagatcgcccgccgcggcggccccgagatctggatcaaggccgccatcctcgtcagcggcttctggtccatgctctacctcatgtgcaccctggacccgaaccgcggcgccatcctggccgccatcgcgctgggcatcgtcgccgccttcgtcggcacgtgcattcagcacgacggcaaccacggcgcgttcgccttctctccgttcatgaacaagctctctggctggacgctcgacatgatcggcgccagtgccatgacctgggagatgcagcacgtgctgggccaccacccgtacaccaacctgatcgagatggagaacggcacccaaaaggtcacccacgccgacgtcgaccccaagaaggccgaccaggagagcgacccggacgtcttcagcacctaccccatgctccgtctgcacccgtggcaccgcaagcgcttctaccaccgcttccagcacctgtacgcgccgctgctcttcggtttcatgaccatcaacaaggtgatcacccaggatgtgggagttgtcctcagcaagcgtctgtttcagatcgatgccaactgccgttacgccagcaagtcgtacgttgcgcgcttctggatcatgaagctgctcaccgtcctctacatggtcgccctccccgtgtacacccagggccttgtcgacgggctcaagctcttcttcatcgcccacttttcgtgcggcgagctgctggccaccatgttcatcgtcaaccacatcatcgagggcgtctcgtacgcctccaaggactctgtcaagggcaccatggcgccgccgcgcacggtgcacggcgtgaccccgatgcatgacacccgcgacgcgctcggcaaggagaaggcagccaccaagcacgtgccgctcaacgactgggccgcggtccagtgccagacctcggtcaactggtcgatcggctcgtggttctggaaccacttctccggcgggctcaaccaccagatcgagcaccacctcttccccggcctcacccacaccacctacgtgtacattcaggatgtggtgcaggcgacgtgcgccgagtacggggtcccgtaccagtcggagcagagcctcttctccgcctacttcaagatgctctcccaccttcgggcgctcggcaacgagccgatgccctcgtgggagaaggaccaccccaagtccaagtgaaagcttacgcgtcgacccgggtatccgtatgatgtgcctgactacgcatgatatcgcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcagatctcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcc

SEQ ID NO: 154 - DNA, 1607 bp, Schizochytrium aggregatum
gcggccgccaattcatgacggtgggcggcgatgaggtgtacagcatggcgcaggtgcgcgaccacaacaccccggacgacgcctggtgcgccatccacggcgaggtgtacgagctgaccaagttcgcccgcacccaccccgggggggacatcatcttgctggccgccggcaaggaggccaccatcctgttcgagacgtaccacgtgcgccccatctccgacgcggtcctgcgcaagtaccgcatcggcaagctcgccgccgccggcaaggatgagccggccaacgacagcacctactacagctgggacagcgacttttacaaggtgctccgccagcgtgtcgtggcgcgtctcgaggagcgcaagatcgcccgccgcggcggccccgagatctggatcaaggccgccatcctcgtcagcggcttctggtccatgctctacctcatgtgcaccctggacccgaaccgcggcgccatcctggccgccatcgcgctgggcatcgtcgccgccttcgtcggcacgtgcattcagcacgacggcaaccacggcgcgttcgccttctctccgttcatgaacaagctctctggctggacgctcgacatgatcggcgccagtgccatgacctgggagatgcagcacgtgctgggccaccacccgtacaccaacctgatcgagatggagaacggcacccaaaaggtcacccacgccgacgtcgaccccaagaaggccgaccaggagagcgacccggacgtcttcagcacctaccccatgctccgtctgcacccgtggcaccgcaagcgcttctaccaccgcttccagcacctgtacgcgccgctgctcttcggtttcatgaccatcaacaaggtgatcacccaggatgtgggagttgtcctcagcaagcgtctgtttcagatcgatgccaactgccgttacgccagcaagtcgtacgttgcgcgcttctggatcatgaagctgctcaccgtcctctacatggtcgccctccccgtgtacacccagggccttgtcgacgggctcaagctcttcttcatcgcccacttttcgtgcggcgagctgctggccaccatgttcatcgtcaaccacatcatcgagggcgtctcgtacgcctccaaggactctgtcaagggcaccatggcgccgccgcgcacggtgcacggcgtgaccccgatgcatgacacccgcgacgcgctcggcaaggagaaggcagccaccaagcacgtgccgctcaacgactgggccgcggtccagtgccagacctcggtcaactggtcgatcggctcgtggttctggaaccacttctccggcgggctcaaccaccagatcgagcaccacctcttccccggcctcacccacaccacctacgtgtacattcaggatgtggtgcaggcgacgtgcgccgagtacggggtcccgtaccagtcggagcagagcctcttctccgcctacttcaagatgctctcccaccttcgggcgctcggcaacgagccgatgccctcgtgggagaaggaccaccccaagtccaagtgaaagcttacgcgtcgacccgggtatccgtatgatgtgcctgactacgcatgatatcgcggccgc

SEQ ID NO: 155 - DNA, 6851 bp, Artificial Sequence
  plasmid pKR1102
  misc_feature (4340)..(4340): n is a, c, g, or t
ggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccggtctagaggatccaaggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgcgtacgtgggcggatcccccgggctgcaggaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactcgacgtacgtcctcgaagagaagggttaataacacattttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggccgccaattcatgacggtgggcggcgatgaggtgtacagcatggcgcaggtgcgcgaccacaacaccccggacgacgcctggtgcgccatccacggcgaggtgtacgagctgaccaagttcgcccgcacccaccccgggggggacatcatcttgctggccgccggcaaggaggccaccatcctgttcgagacgtaccacgtgcgccccatctccgacgcggtcctgcgcaagtaccgcatcggcaagctcgccgccgccggcaaggatgagccggccaacgacagcacctactacagctgggacagcgacttttacaaggtgctccgccagcgtgtcgtggcgcgtctcgaggagcgcaagatcgcccgccgcggcggccccgagatctggatcaaggccgccatcctcgtcagcggcttctggtccatgctctacctcatgtgcaccctggacccgaaccgcggcgccatcctggccgccatcgcgctgggcatcgtcgccgccttcgtcggcacgtgcattcagcacgacggcaaccacggcgcgttcgccttctctccgttcatgaacaagctctctggctggacgctcgacatgatcggcgccagtgccatgacctgggagatgcagcacgtgctgggccaccacccgtacaccaacctgatcgagatggagaacggcacccaaaaggtcacccacgccgacgtcgaccccaagaaggccgaccaggagagcgacccggacgtcttcagcacctaccccatgctccgtctgcacccgtggcaccgcaagcgcttctaccaccgcttccagcacctgtacgcgccgctgctcttcggtttcatgaccatcaacaaggtgatcacccaggatgtgggagttgtcctcagcaagcgtctgtttcagatcgatgccaactgccgttacgccagcaagtcgtacgttgcgcgcttctggatcatgaagctgctcaccgtcctctacatggtcgccctccccgtgtacacccagggccttgtcgacgggctcaagctcttcttcatcgcccacttttcgtgcggcgagctgctggccaccatgttcatcgtcaaccacatcatcgagggcgtctcgtacgcctccaaggactctgtcaagggcaccatggcgccgccgcgcacggtgcacggcgtgaccccgatgcatgacacccgcgacgcgctcggcaaggagaaggcagccaccaagcacgtgccgctcaacgactgggccgcggtccagtgccagacctcggtcaactggtcgatcggctcgtggttctggaaccacttctccggcgggctcaaccaccagatcgagcaccacctcttccccggcctcacccacaccacctacgtgtacattcaggatgtggtgcaggcgacgtgcgccgagtacggggtcccgtaccagtcggagcagagcctcttctccgcctacttcaagatgctctcccaccttcgggcgctcggcaacgagccgatgccctcgtgggagaaggaccaccccaagtccaagtgaaagcttacgcgtcgacccgggtatccgtatgatgtgcctgactacgcatgatatcgc

SEQ ID NO: 156 - DNA, 13424 bp, Artificial Sequence
  plasmid pKR1105
  misc_feature (12229)..(12229): n is a, c, g, or t
ggtcgactcgacgtacgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatggcggatagcccagtcatcaacctcagcaccatgtggaaacccctttcactgatggctttggaccttgccgttttgggacatgtctggaagcaggcacaacaggagggcagcatttcggcctatgctgattctgtttggactcctctcattatgtccggtttatacttatcaatgatcttcgtggggtgccgctggatgaagaaccgtgaaccctttgagatcaaaacatacatgtttgcgtataacctgtatcagaccttgatgaacctttgcatcgtgttgggattcttgtaccaggtgcatgccactgggatgcgcttttggggaagtggtgtcgaccgaagcccaaaaggtttgggcattggcttcttcatttatgcccactaccacaacaagtatgtggaatattttgatacactttttatggtgctgcgaaagaagaacaaccagatttctttccttcacgtgtatcatcatgccctgttgacatgggcttggtttgctgttgtgtatttcgcacctggaggtgatggctggtttggagcttgctacaattcttccatccatgtcctgatgtactcttactacttgcttgcaacttttggcatcagttgcccttggaagaagatcttgacacagctccagatggttcaattctgtttctgttttacacattccatttatgtgtggatttgcgggtcagagatctacccacggcctctgactgctttgcagtcgttcgtgatggtcaatatgttggtgctgtttggcaatttctatgtcaagcaatactcccaaaagaacggcaagccggagaacggagccacccctgagaacggagcgaagccgcaaccttgcgagaacggcacggtggaaaagcgagagaatgacaccgccaacgttcggtgagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacgtacgtctagaggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagctgggtctagaactagaaacgtgatgccacttgttattgaagtcgattacagcatctattctgttttactatttataactttgccatttctgacttttgaaaactatctctggatttcggtatcgctttgtgaagatcgagcaaaagagacgttttgtggacgcaatggtccaaatccgttctacatgaacaaattggtcacaatttccactaaaagtaaataaatggcaagttaaaaaaggaatatgcattttactgattgcctaggtgagctccaagagaagttgaatctacacgtctaccaaccgctaaaaaaagaaaaacattgaatatgtaacctgattccattagcttttgacttcttcaacagattctctacttagatttctaacagaaatattattactagcacatcattttcagtctcactacagcaaaaaatccaacggcacaatacagacaacaggagatatcagactacagagatagatagatgctactgcatgtagtaagttaaataaaaggaaaataaaatgtcttgctaccaaaactactacagactatgatgctcaccacaggccaaatcctgcaactaggacagcattatcttatatatattgtacaaaacaagcatcaaggaacatttggtctaggcaatcagtacctcgttctaccatcaccctcagttatcacatccttgaaggatccattactgggaatcatcggcaacacatgctcctgatggggcacaatgacatcaagaaggtaggggccaggggtgtccaacattctctgaattgccgctctaagctcttccttcttcgtcactcgcgctgccggtatcccacaagcatcagcaaacttgagcatgtttgggaatatctcgctctcgctagacggatctccaagataggtgtgagctctattggacttgtagaacctatcctccaactgaaccaccatacccaaatgctgattgttcaacaacaatatcttaactgggagattctccactcttatagtggccaactcctgaacattcatgatgaaactaccatccccatcaatgtcaaccacaacagccccagggttagcaacagcagcaccaatagccgcaggcaatccaaaacccatggctccaagaccccctgaggtcaaccactgcctcggtctcttgtacttgtaaaactgcgcagcccacatttgatgctgcccaaccccagtactaacaatagcatctccattagtcaactcatcaagaacctcgatagcatgctgcggagaaatcgcgtcctggaatgtcttgtaacccaatggaaacttgtgtttctgcacattaatctcttctctccaacctccaagatcaaacttaccctccactcctttctcctccaaaatcatattaattcccttcaaggccaacttcaaatccgcgcaaaccgacacgtgcgcctgcttgttcttcccaatctcggcagaatcaatatcaatgtgaacaatcttagccctactagcaaaagcctcaagcttcccagtaacacggtcatcaaaccttaccccaaaggcaagcaacaaatcactattgtcaacagcatagttagcataaacagtaccatgcatacccagcatctgaagggaatattcatcaccaataggaaaagttccaagacccattaaagtgctagcaacgggaataccagtgagttcaacaaagcgcctcaattcagcactggaattcaaactgccaccgccgacgtagagaacgggcttttgggcctccatgatgagtctgacaatgtgttccaattgggcctcggcggggggcctgggcagcctggcgaggtaaccggggaggttaacgggctcgtcccaattaggcacggcgagttgctgctgaacgtctttgggaatgtcgatgaggaccggaccggggcggccggaggtggcgacgaagaaagcctcggcgacgacgcgggggatgtcgtcgacgtcgaggatgaggtagttgtgcttcgtgatggatctgctcacctccacgatcggggtttcttggaaggcgtcggtgccgatcatccggcgggcgacctggccggtgatggcgacgactgggacgctgtccattaaagcgtcggcgaggccgctcacgaggttggtggcgccggggccggaggtggcaatgcagacgccggggaggccggaggaacgcgcgtagccttcggcggcgaagacgccgccctgctcgtggcgcgggagcacgttgcggatggcggcggagcgcgtgagcgcctggtggatctccatcgacgcaccgccggggtacgcgaacaccgtcgtcacgccctgcctctccagcgcctccacaaggatgtccgcgcccttgcgaggttcgccggaggcgaaccgtgacacgaagggctccgtggtcggcgcttccttggtgaagggcgccgccgtggggggtttggagatggaacatttgattttgagagcgtggttgggtttggtgagggtttgatgagagagagggagggtggatctagtaatgcgtttggggaaggtggggtgtgaagaggaagaagagaatcgggtggttctggaagcggtggccgccattgtgttgtgtggcatggttatacttcaaaaactgcacaacaagcctagagttagtacctaaacagtaaatttacaacagagagcaaagacacatgcaaaaatttcagccataaaaaaagttataatagaatttaaagcaaaagtttcattttttaaacatatatacaaacaaactggatttgaaggaagggattaattcccctgctcaaagtttgaattcctattgtgacctatactcgaataaaattgaagcctaaggaatgtatgagaaacaagaaaacaaaacaaaactacagacaaacaagtacaattacaaaattcgctaaaattctgtaatcaccaaaccccatctcagtcagcacaaggcccaaggtttattttgaaataaaaaaaaagtgattttatttctcataagctaaaagaaagaaaggcaattatgaaatgatttcgactagatctgaaagtcaaacgcgtattccgcagatattaaagaaagagtagagtttcacatggatcctagatggacccagttgaggaaaaagcaaggcaaagcaaaccagaagtgcaagatccgaaattgaaccacggaatctaggatttggtagagggagaagaaaagtaccttgagaggtagaagagaagagaagagcagagagatatatgaacgagtgtgtcttggtctcaactctgaagcgatacgagtttagaggggagcattgagttccaatttatagggaaaccgggtggcaggggtgagttaatgacggaaaagcccctaagtaacgagattggattgtgggttagattcaaccgtttgcatccgcggcttagattggggaagtcagagtgaatctcaaccgttgactgagttgaaaattgaatgtagcaaccaattgagccaaccccagcctttgccctttgattttgatttgtttgttgcatactttttatttgtcttctggttctgactctctttctctcgtttcaatgccaggttgcctactcccacaccactcacaagaagattctactgttagtattaaatattttttaatgtattaaatgatgaatgcttttgtaaacagaacaagactatgtctaataagtgtcttgcaacattttttaagaaattaaaaaaaatatatttattatcaaaatcaaatgtatgaaaaatcatgaataatataattttatacatttttttaaaaaatcttttaatttcttaattaatatcttaaaaataatgattaatatttaacccaaaataattagtatgattggtaaggaagatatccatgttatgtttggatgtgagtttgatctagagcaaagcttactagagtcgacctgcagcccgggggatccgcccacgtacgcaaaggcaaagatttaaactcgaaaacattacaaaagtctcaaaacagaggcaaggccatgcacaaagcacactctaagtgcttccattgcctactaagtagggtacgtacacgatcaccattcaccagtgatgatctttattaatatacaacacactcagagacagcttatgttatagctagctagcataaactatcacatcatgtgttagtacgacaagtgacaacattgcttttaacttcgcggccttggatcctctagaccggatataatgagccgtaaacaaagatgattaagtagtaattaatacgtactagtaaaagtggcaaaagataacgagaaagaaccaatttctttgcattcggccttagcggaaggcatatataagctttgattattttatttagtgtaatgatttcgtacaaccaaagcatttatttagtactctcacacttgtgtcgcggccgcgatatcatgcgtagtcaggcacatcatacggatacccgggtcgacgcgtaagctttcacttggacttggggtggtccttctcccacgagggcatcggctcgttgccgagcgcccgaaggtgggagagcatcttgaagtaggcggagaagaggctctgctccgactggtacgggaccccgtactcggcgcacgtcgcctgcaccacatcctgaatgtacacgtaggtggtgtgggtgaggccggggaagaggtggtgctcgatctggtggttgagcccgccggagaagtggttccagaaccacgagccgatcgaccagttgaccgaggtctggcactggaccgcggcccagtcgttgagcggcacgtgcttggtggctgccttctccttgccgagcgcgtcgcgggtgtcatgcatcggggtcacgccgtgcaccgtgcgcggcggcgccatggtgcccttgacagagtccttggaggcgtacgagacgccctcgatgatgtggttgacgatgaacatggtggccagcagctcgccgcacgaaaagtgggcgatgaagaagagcttgagcccgtcgacaaggccctgggtgtacacggggagggcgaccatgtagaggacggtgagcagcttcatgatccagaagcgcgcaacgtacgacttgctggcgtaacggcagttggcatcgatctgaaacagacgcttgctgaggacaactcccacatcctgggtgatcaccttgttgatggtcatgaaaccgaagagcagcggcgcgtacaggtgctggaagcggtggtagaagcgcttgcggtgccacgggtgcagacggagcatggggtaggtgctgaagacgtccgggtcgctctcctggtcggccttcttggggtcgacgtcggcgtgggtgaccttttgggtgccgttctccatctcgatcaggttggtgtacgggtggtggcccagcacgtgctgcatctcccaggtcatggcactggcgccgatcatgtcgagcgtccagccagagagcttgttcatgaacggagagaaggcgaacgcgccgtggttgccgtcgtgctgaatgcacgtgccgacgaaggcggcgacgatgcccagcgcgatggcggccaggatggcgccgcggttcgggtccagggtgcacatgaggtagagcatggaccagaagccgctgacgaggatggcggccttgatccagatctcggggccgccgcggcgggcgatcttgcgctcctcgagacgcgccacgacacgctggcggagcaccttgtaaaagtcgctgtcccagctgtagtaggtgctgtcgttggccggctcatccttgccggcggcggcgagcttgccgatgcggtacttgcgcaggaccgcgtcggagatggggcgcacgtggtacgtctcgaacaggatggtggcctccttgccggcggccagcaagatgatgtcccccccggggtgggtgcgggcgaacttggtcagctcgtacacctcgccgtggatggcgcaccaggcgtcgtccggggtgttgtggtcgcgcacctgcgccatgctgtacacctcatcgccgcccaccgtcatgaattggcggccgcttggggggctatggaagactttcttagttagttgtgtgaataagcaatgttgggagaatcgggactacttataggataggaataaaacagaaaagtattaagtgctaatgaaatatttagactgataattaaaatcttcacgtatgtccacttgatataaaaacgtcaggaataaaggaagtacagtagaatttaaaggtactctttttatatatacccgtgttctctttttggctagctagttgcataaaaaataatctatatttttatcattattttaaatatcttatgagatggtaaatatttatcataattttttttactattatttattatttgtgtgtgtaatacatatagaagttaattacaaattttatttactttttcattattttgatatgattcaccattaatttagtgttattatttataatagttcattttaatctttttgtatatattatgcgtgcagtacttttttcctacatataactactattacattttatttatataatatttttattaatgaattttcgtgataatatgtaatattgttcattattatttcagattttttaaaaatatttgtgttattatttatgaaatatgtaatttttttagtatttgattttatgatgataaagtgttctaaattcaaaagaagggggaaagcgtaaacattaaaaaacgtcatcaaacaaaaacaaaatcttgttaataaagataaaactgtttgttttgatcactgttatttcgtaatataaaaacattatttatatttatattgttgacaaccaaatttgcctatcaaatctaaccaatataatgcatgcgtggcaggtaatgtactaccatgaacttaagtcatgacataataaaccgtgaatctgaccaatgcatgtacctanctaaattgtatttgtgacacgaagcaaatgattcaattcacaatggagatgggaaacaaataatgaagaacccagaactaagaaagcttttctgaaaaataaaataaaggcaatgtcaaaagtatactgcatcatcagtccagaaagcacatgatatttttttatcagtatcaatgcagctagttttattttacaatatcgatatagctagtttaaatatattgcagctagatttataaatatttgtgttattatttatcatttgtgtaatcctgtttttagtattttagtttatatatgatgataatgtattccaaatttaaaagaagggaaataaatttaaacaagaaaaaaagtcatcaaacaaaaaacaaatgaaagggtggaaagatgttaccatgtaatgtgaatgttacagtatttcttttattatagagttaacaaattaactaatatgattttgttaataatgataaaatattttttttattattatttcataatataaaaatagtttacttaatataaaaaaaattctatcgttcacaacaaagttggccacctaatttaaccatgcatgtacccatggaccatattaggtaaccatcaaacctgatgaagagataaagagatgaagacttaagtcataacacaaaaccataaaaaacaaaaatacaatcaaccgtcaatctgaccaatgcatgaaaaagctgcaatagtgagtggcgacacaaagcacatgattttcttacaacggagataaaaccaaaaaaatatttcatgaacaacctagaacaaataaagcttttatataataaatatataaataaataaaggctatggaataatatacttcaatatatttggattaaataaattgttggcggggttgatatatttatacacacctaaagtcacttcaatctcattttcacttaacttttattttttttttctttttatttatcataaagagaatattgataatatactttttaacatatttttatgacattttttattggtgaaaacttattaaaaatcataaattttgtaagttagatttatttaaagagttcctcttcttattttaaattttttaataaatttttaaataactaaaatttgtgttaaaaatgttaaaaaatgtgttattaacccttctcttcgaggacgtacgtcgagtcgacctgca

SEQ ID NO: 157 - DNA, 27 bp, Artificial Sequence
  primer oEUGsyn6-4
tcctgcagagacactgccagggagtcg

SEQ ID NO: 158 - DNA, 4498 bp, Artificial Sequence
  plasmid pKR1107
aattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaagcccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgtatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgccagtgtgatggatatctgcagaattcagggcggccgcaccatggcggatagcccagtcatcaacctcagcaccatgtggaaacccctttcactgatggctttggaccttgccgttttgggacatgtctggaagcaggcacaacaggagggcagcatttcggcctatgctgattctgtttggactcctctcattatgtccggtttatacttatcaatgatcttcgtggggtgccgctggatgaagaaccgtgaaccctttgagatcaaaacatacatgtttgcgtataacctgtatcagaccttgatgaacctttgcatcgtgttgggattcttgtaccaggtgcatgccactgggatgcgcttttggggaagtggtgtcgaccgaagcccaaaaggtttgggcattggcttcttcatttatgcccactaccacaacaagtatgtggaatattttgatacactttttatggtgctgcgaaagaagaacaaccagatttctttccttcacgtgtatcatcatgccctgttgacatgggcttggtttgctgttgtgtatttcgcacctggaggtgatggctggtttggagcttgctacaattcttccatccatgtcctgatgtactcttactacttgcttgcaacttttggcatcagttgcccttggaagaagatcttgacacagctccagatggttcaattctgtttctgttttacacattccatttatgtgtggatttgcgggtcagagatctacccacggcctctgactgctttgcagtcgttcgtgatggtcaatatgttggtgctgtttggcaatttctatgtcaagcaatactcccaaaagaacggcaagccggagaacggagccacccctgagaacggagcgaagccgcaaccttgcgagaacggcacggtggaaaagcgagagaatgacaccgccaacgttcggcccgcccgtccagctggactcccgccggccacgtactacgactccctggcagtgtctctgcaggacctg

SEQ ID NO: 159 - DNA, 4461 bp, Artificial Sequence
  plasmid pKR1112
ggccgcaccatggcggatagcccagtcatcaacctcagcaccatgtggaaacccctttcactgatggctttggaccttgccgttttgggacatgtctggaagcaggcacaacaggagggcagcatttcggcctatgctgattctgtttggactcctctcattatgtccggtttatacttatcaatgatcttcgtggggtgccgctggatgaagaaccgtgaaccctttgagatcaaaacatacatgtttgcgtataacctgtatcagaccttgatgaacctttgcatcgtgttgggattcttgtaccaggtgcatgccactgggatgcgcttttggggaagtggtgtcgaccgaagcccaaaaggtttgggcattggcttcttcatttatgcccactaccacaacaagtatgtggaatattttgatacactttttatggtgctgcgaaagaagaacaaccagatttctttccttcacgtgtatcatcatgccctgttgacatgggcttggtttgctgttgtgtatttcgcacctggaggtgatggctggtttggagcttgctacaattcttccatccatgtcctgatgtactcttactacttgcttgcaacttttggcatcagttgcccttggaagaagatcttgacacagctccagatggttcaattctgtttctgttttacacattccatttatgtgtggatttgcgggtcagagatctacccacggcctctgactgctttgcagtcgttcgtgatggtcaatatgttggtgctgtttggcaatttctatgtcaagcaatactcccaaaagaacggcaagccggagaacggagccacccctgagaacggagcgaagccgcaaccttgcgagaacggcacggtggaaaagcgagagaatgacaccgccaacgttcggcccgcccgtccagctggactcccgccggccacgtactacgactccctggcagtgtctctgcaggacctgaattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaagcccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgtatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagc

SEQ ID NO: 160 - DNA, 5989 bp, Artificial Sequence
  plasmid pKR115
  misc_feature (5357)..(5357): n is a, c, g, or t
ctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgtatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgcaccatggcggatagcccagtcatcaacctcagcaccatgtggaaacccctttcactgatggctttggaccttgccgttttgggacatgtctggaagcaggcacaacaggagggcagcatttcggcctatgctgattctgtttggactcctctcattatgtccggtttatacttatcaatgatcttcgtggggtgccgctggatgaagaaccgtgaaccctttgagatcaaaacatacatgtttgcgtataacctgtatcagaccttgatgaacctttgcatcgtgttgggattcttgtaccaggtgcatgccactgggatgcgcttttggggaagtggtgtcgaccgaagcccaaaaggtttgggcattggcttcttcatttatgcccactaccacaacaagtatgtggaatattttgatacactttttatggtgctgcgaaagaagaacaaccagatttctttccttcacgtgtatcatcatgccctgttgacatgggcttggtttgctgttgtgtatttcgcacctggaggtgatggctggtttggagcttgctacaattcttccatccatgtcctgatgtactcttactacttgcttgcaacttttggcatcagttgcccttggaagaagatcttgacacagctccagatggttcaattctgtttctgttttacacattccatttatgtgtggatttgcgggtcagagatctacccacggcctctgactgctttgcagtcgttcgtgatggtcaatatgttggtgctgtttggcaatttctatgtcaagcaatactcccaaaagaacggcaagccggagaacggagccacccctgagaacggagcgaagccgcaaccttgcgagaacggcacggtggaaaagcgagagaatgacaccgccaacgttcggcccgcccgtccagctggactcccgccggccacgtactacgactccctggcagtgtctctgcagggcggcgatgaggtgtacagcatggcgcaggtgcgcgaccacaacaccccggacgacgcctggtgcgccatccacggcgaggtgtacgagctgaccaagttcgcccgcacccaccccgggggggacatcatcttgctggccgccggcaaggaggccaccatcctgttcgagacgtaccacgtgcgccccatctccgacgcggtcctgcgcaagtaccgcatcggcaagctcgccgccgccggcaaggatgagccggccaacgacagcacctactacagctgggacagcgacttttacaaggtgctccgccagcgtgtcgtggcgcgtctcgaggagcgcaagatcgcccgccgcggcggccccgagatctggatcaaggccgccatcctcgtcagcggcttctggtccatgctctacctcatgtgcaccctggacccgaaccgcggcgccatcctggccgccatcgcgctgggcatcgtcgccgccttcgtcggcacgtgcattcagcacgacggcaaccacggcgcgttcgccttctctccgttcatgaacaagctctctggctggacgctcgacatgatcggcgccagtgccatgacctgggagatgcagcacgtgctgggccaccacccgtacaccaacctgatcgagatggagaacggcacccaaaaggtcacccacgccgacgtcgaccccaagaaggccgaccaggagagcgacccggacgtcttcagcacctaccccatgctccgtctgcacccgtggcaccgcaagcgcttctaccaccgcttccagcacctgtacgcgccgctgctcttcggtttcatgaccatcaacaaggtgatcacccaggatgtgggagttgtcctcagcaagcgtctgtttcagatcgatgccaactgccgttacgccagcaagtcgtacgttgcgcgcttctggatcatgaagctgctcaccgtcctctacatggtcgccctccccgtgtacacccagggccttgtcgacgggctcaagctcttcttcatcgcccacttttcgtgcggcgagctgctggccaccatgttcatcgtcaaccacatcatcgagggcgtctcgtacgcctccaaggactctgtcaagggcaccatggcgccgccgcgcacggtgcacggcgtgaccccgatgcatgacacccgcgacgcgctcggcaaggagaaggcagccaccaagcacgtgccgctcaacgactgggccgcggtccagtgccagacctcggtcaactggtcgatcggctcgtggttctggaaccacttctccggcgggctcaaccaccagatcgagcaccacctcttccccggcctcacccacaccacctacgtgtacattcaggatgtggtgcaggcgacgtgcgccgagtacggggtcccgtaccagtcggagcagagcctcttctccgcctacttcaagatgctctcccaccttcgggcgctcggcaacgagccgatgccctcgtgggagaaggaccaccccaagtccaagtgagcggccgcccntgaattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaagcccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcg

SEQ ID NO: 161 - DNA, 10807 bp, Artificial Sequence
  plasmid pKR1134
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacgtacgtctagaggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagctgggtctagaactagaaacgtgatgccacttgttattgaagtcgattacagcatctattctgttttactatttataactttgccatttctgacttttgaaaactatctctggatttcggtatcgctttgtgaagatcgagcaaaagagacgttttgtggacgcaatggtccaaatccgttctacatgaacaaattggtcacaatttccactaaaagtaaataaatggcaagttaaaaaaggaatatgcattttactgattgcctaggtgagctccaagagaagttgaatctacacgtctaccaaccgctaaaaaaagaaaaacattgaatatgtaacctgattccattagcttttgacttcttcaacagattctctacttagatttctaacagaaatattattactagcacatcattttcagtctcactacagcaaaaaatccaacggcacaatacagacaacaggagatatcagactacagagatagatagatgctactgcatgtagtaagttaaataaaaggaaaataaaatgtcttgctaccaaaactactacagactatgatgctcaccacaggccaaatcctgcaactaggacagcattatcttatatatattgtacaaaacaagcatcaaggaacatttggtctaggcaatcagtacctcgttctaccatcaccctcagttatcacatccttgaaggatccattactgggaatcatcggcaacacatgctcctgatggggcacaatgacatcaagaaggtaggggccaggggtgtccaacattctctgaattgccgctctaagctcttccttcttcgtcactcgcgctgccggtatcccacaagcatcagcaaacttgagcatgtttgggaatatctcgctctcgctagacggatctccaagataggtgtgagctctattggacttgtagaacctatcctccaactgaaccaccatacccaaatgctgattgttcaacaacaatatcttaactgggagattctccactcttatagtggccaactcctgaacattcatgatgaaactaccatccccatcaatgtcaaccacaacagccccagggttagcaacagcagcaccaatagccgcaggcaatccaaaacccatggctccaagaccccctgaggtcaaccactgcctcggtctcttgtacttgtaaaactgcgcagcccacatttgatgctgcccaaccccagtactaacaatagcatctccattagtcaactcatcaagaacctcgatagcatgctgcggagaaatcgcgtcctggaatgtcttgtaacccaatggaaacttgtgtttctgcacattaatctcttctctccaacctccaagatcaaacttaccctccactcctttctcctccaaaatcatattaattcccttcaaggccaacttcaaatccgcgcaaaccgacacgtgcgcctgcttgttcttcccaatctcggcagaatcaatatcaatgtgaacaatcttagccctactagcaaaagcctcaagcttcccagtaacacggtcatcaaaccttaccccaaaggcaagcaacaaatcactattgtcaacagcatagttagcataaacagtaccatgcatacccagcatctgaagggaatattcatcaccaataggaaaagttccaagacccattaaagtgctagcaacgggaataccagtgagttcaacaaagcgcctcaattcagcactggaattcaaactgccaccgccgacgtagagaacgggcttttgggcctccatgatgagtctgacaatgtgttccaattgggcctcggcggggggcctgggcagcctggcgaggtaaccggggaggttaacgggctcgtcccaattaggcacggcgagttgctgctgaacgtctttgggaatgtcgatgaggaccggaccggggcggccggaggtggcgacgaagaaagcctcggcgacgacgcgggggatgtcgtcgacgtcgaggatgaggtagttgtgcttcgtgatggatctgctcacctccacgatcggggtttcttggaaggcgtcggtgccgatcatccggcgggcgacctggccggtgatggcgacgactgggacgctgtccattaaagcgtcggcgaggccgctcacgaggttggtggcgccggggccggaggtggcaatgcagacgccggggaggccggaggaacgcgcgtagccttcggcggcgaagacgccgccctgctcgtggcgcgggagcacgttgcggatggcggcggagcgcgtgagcgcctggtggatctccatcgacgcaccgccggggtacgcgaacaccgtcgtcacgccctgcctctccagcgcctccacaaggatgtccgcgcccttgcgaggttcgccggaggcgaaccgtgacacgaagggctccgtggtcggcgcttccttggtgaagggcgccgccgtggggggtttggagatggaacatttgattttgagagcgtggttgggtttggtgagggtttgatgagagagagggagggtggatctagtaatgcgtttggggaaggtggggtgtgaagaggaagaagagaatcgggtggttctggaagcggtggccgccattgtgttgtgtggcatggttatacttcaaaaactgcacaacaagcctagagttagtacctaaacagtaaatttacaacagagagcaaagacacatgcaaaaatttcagccataaaaaaagttataatagaatttaaagcaaaagtttcattttttaaacatatatacaaacaaactggatttgaaggaagggattaattcccctgctcaaagtttgaattcctattgtgacctatactcgaataaaattgaagcctaaggaatgtatgagaaacaagaaaacaaaacaaaactacagacaaacaagtacaattacaaaattcgctaaaattctgtaatcaccaaaccccatctcagtcagcacaaggcccaaggtttattttgaaataaaaaaaaagtgattttatttctcataagctaaaagaaagaaaggcaattatgaaatgatttcgactagatctgaaagtcaaacgcgtattccgcagatattaaagaaagagtagagtttcacatggatcctagatggacccagttgaggaaaaagcaaggcaaagcaaaccagaagtgcaagatccgaaattgaaccacggaatctaggatttggtagagggagaagaaaagtaccttgagaggtagaagagaagagaagagcagagagatatatgaacgagtgtgtcttggtctcaactctgaagcgatacgagtttagaggggagcattgagttccaatttatagggaaaccgggtggcaggggtgagttaatgacggaaaagcccctaagtaacgagattggattgtgggttagattcaaccgtttgcatccgcggcttagattggggaagtcagagtgaatctcaaccgttgactgagttgaaaattgaatgtagcaaccaattgagccaaccccagcctttgccctttgattttgatttgtttgttgcatactttttatttgtcttctggttctgactctctttctctcgtttcaatgccaggttgcctactcccacaccactcacaagaagattctactgttagtattaaatattttttaatgtattaaatgatgaatgcttttgtaaacagaacaagactatgtctaataagtgtcttgcaacattttttaagaaattaaaaaaaatatatttattatcaaaatcaaatgtatgaaaaatcatgaataatataattttatacatttttttaaaaaatcttttaatttcttaattaatatcttaaaaataatgattaatatttaacccaaaataattagtatgattggtaaggaagatatccatgttatgtttggatgtgagtttgatctagagcaaagcttactagagtcgacctgcaggtcgactcgacgtacgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatggcggatagcccagtcatcaacctcagcaccatgtggaaacccctttcactgatggctttggaccttgccgttttgggacatgtctggaagcaggcacaacaggagggcagcatttcggcctatgctgattctgtttggactcctctcattatgtccggtttatacttatcaatgatcttcgtggggtgccgctggatgaagaaccgtgaaccctttgagatcaaaacatacatgtttgcgtataacctgtatcagaccttgatgaacctttgcatcgtgttgggattcttgtaccaggtgcatgccactgggatgcgcttttggggaagtggtgtcgaccgaagcccaaaaggtttgggcattggcttcttcatttatgcccactaccacaacaagtatgtggaatattttgatacactttttatggtgctgcgaaagaagaacaaccagatttctttccttcacgtgtatcatcatgccctgttgacatgggcttggtttgctgttgtgtatttcgcacctggaggtgatggctggtttggagcttgctacaattcttccatccatgtcctgatgtactcttactacttgcttgcaacttttggcatcagttgcccttggaagaagatcttgacacagctccagatggttcaattctgtttctgttttacacattccatttatgtgtggatttgcgggtcagagatctacccacggcctctgactgctttgcagtcgttcgtgatggtcaatatgttggtgctgtttggcaatttctatgtcaagcaatactcccaaaagaacggcaagccggagaacggagccacccctgagaacggagcgaagccgcaaccttgcgagaacggcacggtggaaaagcgagagaatgacaccgccaacgttcggcccgcccgtccagctggactcccgccggccacgtactacgactccctggcagtgtctctgcagggcggcgatgaggtgtacagcatggcgcaggtgcgcgaccacaacaccccggacgacgcctggtgcgccatccacggcgaggtgtacgagctgaccaagttcgcccgcacccaccccgggggggacatcatcttgctggccgccggcaaggaggccaccatcctgttcgagacgtaccacgtgcgccccatctccgacgcggtcctgcgcaagtaccgcatcggcaagctcgccgccgccggcaaggatgagccggccaacgacagcacctactacagctgggacagcgacttttacaaggtgctccgccagcgtgtcgtggcgcgtctcgaggagcgcaagatcgcccgccgcggcggccccgagatctggatcaaggccgccatcctcgtcagcggcttctggtccatgctctacctcatgtgcaccctggacccgaaccgcggcgccatcctggccgccatcgcgctgggcatcgtcgccgccttcgtcggcacgtgcattcagcacgacggcaaccacggcgcgttcgccttctctccgttcatgaacaagctctctggctggacgctcgacatgatcggcgccagtgccatgacctgggagatgcagcacgtgctgggccaccacccgtacaccaacctgatcgagatggagaacggcacccaaaaggtcacccacgccgacgtcgaccccaagaaggccgaccaggagagcgacccggacgtcttcagcacctaccccatgctccgtctgcacccgtggcaccgcaagcgcttctaccaccgcttccagcacctgtacgcgccgctgctcttcggtttcatgaccatcaacaaggtgatcacccaggatgtgggagttgtcctcagcaagcgtctgtttcagatcgatgccaactgccgttacgccagcaagtcgtacgttgcgcgcttctggatcatgaagctgctcaccgtcctctacatggtcgccctccccgtgtacacccagggccttgtcgacgggctcaagctcttcttcatcgcccacttttcgtgcggcgagctgctggccaccatgttcatcgtcaaccacatcatcgagggcgtctcgtacgcctccaaggactctgtcaagggcaccatggcgccgccgcgcacggtgcacggcgtgaccccgatgcatgacacccgcgacgcgctcggcaaggagaaggcagccaccaagcacgtgccgctcaacgactgggccgcggtccagtgccagacctcggtcaactggtcgatcggctcgtggttctggaaccacttctccggcgggctcaaccaccagatcgagcaccacctcttccccggcctcacccacaccacctacgtgtacattcaggatgtggtgcaggcgacgtgcgccgagtacggggtcccgtaccagtcggagcagagcctcttctccgcctacttcaagatgctctcccaccttcgggcgctcggcaacgagccgatgccctcgtgggagaaggaccaccccaagtccaagtgagc

SEQ ID NO: 162 - DNA, 1260 bp, Tetruetreptia pomquetensis CCMP1491
  misc_feature (1)..(1260): U.S. Patent Application No. 11/876,115 (filed October 22, 2007)
atgtctcctaagcggcaagctctgccaatcacaattgatggcgcaacttatgatgtgtctgcttgggtcaatcaccaccctggaggagctgacattatcgagaactatcgcaaccgcgatgcgaccgatgtcttcatggtgatgcactctcaagaagccgtcgccaagttgaagagaatgcctgttatggagccttcctctcctgacacacctgttgcacccaagcctaagcgtgatgagccccaggaggatttccgcaagttgcgggaggaattcatctccaagggtatgttcgagacgagtttcctttggtatttttacaagacttcaactaccgtcggtttgatggtcctttccatcttgatgaccgtgtacacgaattggtatttcaccgctgctttggttcttggcgtgtgctaccaacagctaggctggttgtcccacgactattgccatcaccaggttttcacaaaccgcaagattaacgacgctttcggtctctttttcggtaacgtgatgcagggatactcacagacttggtggaaggataggcacaatggtcaccatgccgccaccaatgtggtcggccatgacccagatattgataacctccccatcctggcttggtctcccgaagatgtcaagagggctactccttcgactcggaatctcatcaagtaccagcagtactacttcattcccaccattgcatcccttaggttcatctggtgcctccaatccatcggcggcgtcatgtcctacaagagcgaggagaggaacctgtactacaagcgccagtacactaaggaggcgattggtctggccctccactgggtgctcaaggccactttctattgcagtgccatgcctagctttgccaccggtttgggatgcttcttgatctccgagctgctcggaggatttggcattgccatcgttgtgtttctgaatcactatcctttggacaaggttgaggagactgtctgggatgagcacgggttcagcgccagccagatccacgagacgttgaacattaagcccggccttctcaccgattgggtctttggtggtctcaactaccagattgagcaccacttgtggcccaacatgcccaggcacaacctcacggcagcttccctggaggtgcagaagttgtgcgccaagcacaacctgccctacagggccccagccatcatccccggggttcagaaattggtcagcttcttaggcgagattgcccagctggctgctgtccctgaa

SEQ ID NO: 163 - DNA, 31 bp, Artificial Sequence
  primer TpomNot-5
gcggccgcaccatgtctcctaagcggcaagc

SEQ ID NO: 164 - DNA, 27 bp, Artificial Sequence
  primer TpomNot-3
gcggccgctcattcagggacagcagcc

SEQ ID NO: 165 - DNA, 4300 bp, Artificial Sequence
  plasmid pLF114-10
taatacgactcactatagggcgaattgggcccgacgtcgcatgctcccggccgccatggcggccgcgggaattcgattggcggccgcaccatgtctcctaagcggcaagctctgccaatcacaattgatggcgcaacttatgatgtgtctgcttgggtcaatcaccaccctggaggagctgacattatcgagaactatcgcaaccgcgatgcgaccgatgtcttcatggtgatgcactctcaagaagccgtcgccaagttgaagagaatgcctgttatggagccttcctctcctgacacacctgttgcacccaagcctaagcgtgatgagccccaggaggatttccgcaagttgcgggaggaattcatctccaagggtatgttcgagacgagtttcctttggtatttttacaagacttcaactaccgtcggtttgatggtcctttccatcttgatgaccgtgtacacgaattggtatttcaccgctgctttggttcttggcgtgtgctaccaacagctaggctggttgtcccacgactattgccatcaccaggttttcacaaaccgcaagattaacgacgctttcggtctctttttcggtaacgtgatgcagggatactcacagacttggtggaaggataggcacaatggtcaccatgccgccaccaatgtggtcggccatgacccagatattgataacctccccatcctggcttggtctcccgaagatgtcaagagggctactccttcgactcggaatctcatcaagtaccagcagtactacttcattcccaccattgcatcccttaggttcatctggtgcctccaatccatcggcggcgtcatgtcctacaagagcgaggagaggaacctgtactacaagcgccagtacactaaggaggcgattggtctggccctccactgggtgctcaaggccactttctattgcagtgccatgcctagctttgccaccggtttgggatgcttcttgatctccgagctgctcggaggatttggcattgccatcgttgtgtttctgaatcactatcctttggacaaggttgaggagactgtctgggatgagcacgggttcagcgccagccagatccacgagacgttgaacattaagcccggccttctcaccgattgggtctttggtggtctcaactaccagattgagcaccacttgtggcccaacatgcccaggcacaacctcacggcagcttccctggaggtgcagaagttgtgcgccaagcacaacctgccctacagggccccagccatcatccccggggttcagaaattggtcagcttcttaggcgagattgcccagctggctgctgtccctgaatgagcggccgcaatcactagtgaattcgcggccgcctgcaggtcgaccatatgggagagctcccaacgcgttggatgcatagcttgagtattctatagtgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattg

SEQ ID NO: 166 - DNA, 5754 bp, Artificial Sequence
  plasmid pKR1002
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacctgcaggtctagaggatccccgggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactctagacctgcaggatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatgtctcctaagcggcaagctctgccaatcacaattgatggcgcaacttatgatgtgtctgcttgggtcaatcaccaccctggaggagctgacattatcgagaactatcgcaaccgcgatgcgaccgatgtcttcatggtgatgcactctcaagaagccgtcgccaagttgaagagaatgcctgttatggagccttcctctcctgacacacctgttgcacccaagcctaagcgtgatgagccccaggaggatttccgcaagttgcgggaggaattcatctccaagggtatgttcgagacgagtttcctttggtatttttacaagacttcaactaccgtcggtttgatggtcctttccatcttgatgaccgtgtacacgaattggtatttcaccgctgctttggttcttggcgtgtgctaccaacagctaggctggttgtcccacgactattgccatcaccaggttttcacaaaccgcaagattaacgacgctttcggtctctttttcggtaacgtgatgcagggatactcacagacttggtggaaggataggcacaatggtcaccatgccgccaccaatgtggtcggccatgacccagatattgataacctccccatcctggcttggtctcccgaagatgtcaagagggctactccttcgactcggaatctcatcaagtaccagcagtactacttcattcccaccattgcatcccttaggttcatctggtgcctccaatccatcggcggcgtcatgtcctacaagagcgaggagaggaacctgtactacaagcgccagtacactaaggaggcgattggtctggccctccactgggtgctcaaggccactttctattgcagtgccatgcctagctttgccaccggtttgggatgcttcttgatctccgagctgctcggaggatttggcattgccatcgttgtgtttctgaatcactatcctttggacaaggttgaggagactgtctgggatgagcacgggttcagcgccagccagatccacgagacgttgaacattaagcccggccttctcaccgattgggtctttggtggtctcaactaccagattgagcaccacttgtggcccaacatgcccaggcacaacctcacggcagcttccctggaggtgcagaagttgtgcgccaagcacaacctgccctacagggccccagccatcatccccggggttcagaaattggtcagcttcttaggcgagattgcccagctggctgctgtccctgaatgagc

SEQ ID NO: 167 - DNA, 11725 bp, Artificial Sequence
  plasmid pKR1095
ggatctggccggccggatctcgtacggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatcgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttggatctcctgcagcccgggggatccgcccacgtacggtaccatctgctaatattttaaatcacatgcaagagaggaggcatggttccattttctaccttcacattatttgagaaaaacgaacttgttctgtgttttatttttgcccttcacattagtacaacgtggaagactcatggttacacagaatcatacataagtacaatgcttgtccctaagaaaacaagcactcgttgtattgaacctttacggctcatgcggccgcgaattcactagtgattgaattcgcggccgcttagtccgacttggccttggcggccgcggccgactctttgagcgtgaagatctgcgccgtctcgggcacagcgccgtagttgacaaagaggtgcgcggtcttgaagaaggccgtgatgatgggctcgtcgttcctgcgcacgaggtgcgggtacgcggccgcaaagtgcttggtggcttcgttgagcttgtagtgcggaatgatcgggaacaagtggtggacctggtgcgtgccaatgtggtggctcaggttgtccacgaacgcgccgtacgagcggtcgacgctcgagaggttgcccttgacgtacgtccactccgagtcgccgtaccacggcgtcgcttcgtcgttgtggtgcaagaaggtcgtaatgacgaggaacgaagcaaagacaaagagcggcgcatagtagtagaggcccatgacggcaaagccgagcgagtatgtgaggtacgcgtacgcggcgaagaaggcggcccagacgccgagcgacacgatgacggccgacgcgcggcgaaggaggagcgggtcccacgggtcaaagtggctcatcgtgcgcggggcatacccgaccttcaagtagacaaaccacgcaccgccgagcgtgtagacccattggcgcacgtcctggaggtccttgaccgaccggtgcgggtaaaagatctcgtccttatcaatgttgcccgtgttcttgtggtggtggcggtgcgtcacgcgccagctctcgaacggcgtcaaaatcgcagagtgcatgatgcagccgatgataaagttgacgctgtggtagcgcgagaaggccgagtggccgcagtcgtggccgaccgtgaagaagccccagaagatgacgccctgcacgtagatgtaggtggcgcaaacgagcgcgtggagcagaacgttatcggcaatgaacggcgtcgagcgcgccgcgtagagcagcgccgccgaggccgacgcgttgaagatcgcgcgggccgtgtagtagagcgagaggccgaggttcgactcaaagcacgcgttcgggatcgagtgcttgagctccgtgagcgtcgggaactcgaccttcgtcttatcctcagtcatgcggccgctgaagtattgcttcttagttaacctttcctttctctctcagctatgtgaattcattttgctttcgtcacaatttatatagtgaaattggatctttggagttaacgccttcacaggattatcgtgttagaacaatgctttttcatgttctaattagtagtacattacaaatgtgcactctattcaataagcatcttttggcacgttaataaatcatgtgaaaaaaaaatactactatttcaaagaaagtgttgtaaaaagaaacggaaagagagctggcttcagttgttgagacttgtttgctagtaaaaatggtgtgaagagtgattcatggtgaggtggtttttcgtccctttctgtttgcatgaaaaacaaatggcaagagatgacgtaggattccttcccttaacgattatctgtttttaatttcaaatatacatataggaatttatgaattactaaggttgtaaaatatgctggtcatttatttatggctaaaatatttttttttctcgtaaatataaaaatatttaaaatttatttttatcatattttttatccttataaaattatgtgtacaacctatataaaaaaatatcatatttaatattgattatatgtttaatcaatataaaaaatcattatcatatatttagatttattcgaatatacatctaaacaaaaaataacatattttaattttatgaagaaaaaaaaatattttatcctttatttatttaagattaattaatagttatgtattgtggaaagacttttacacatgcaatagatatactgaatcaattagatgccaatgctgagttggaaatcacttgaggaggggaggagacttgccaatgcttttcagtttcatttaaatgatttagtggaggagatagagtagtgataaaggcatgccccaattttggagtgtatatatgagtggaaataagagagggatagagagaaaaaataaagagagtaaaaataattaatgtgaaatgatatgataaaaaaataaagaaagagataaagagaaaaatgaaatgagagatagatgaaatagagagtagatacatgtttgtttaggttttttttaggaaataacacatttttttctcatcacttattactcactgtcaatttcctctctttcaatcataatgatatgatttgtttaacaaaaatgtgaaaaaacatataaagtaaaatatttttataaattgataaataaaaatttacaaaatttatttcttattaaattgaatagaaaatgaaagaaaagaaaagaaaaagtatatataaaatgatatagctttaaaaagaataaatttttcatatcagtctttttttaataatttagaaatatttaagtatatagcaaaaatataatgtactttacatatgcataaataataatttgaaaatagaactaatagaatagagaaaaaagtaatataataattaactatatgaaaatttagaagggacaatatttttaattaagaatataaacaatatttcttttcatgtaatgagggacggatgtacggggccagtgttggagtcaaagccaaaatagtcacggggaaattaatgcactgcatgactattcgaaaaaattcactagccttacttagatgttagattaatagctagggggtgcagataattttgaaaggcatgaaaaacattaatttgtacattgcaagcttttgatgacaagctttgcaattgttcacactaccttatgccatttataaatagagtgattggcatatgaaggaaatcatgagagtcgaagcgaaaaacaaagcttgagagtgtaggaaaaatacagtttttttggtaaaaatacagtatttgaataggagcgaaaaatatcctttcaaaatgatccttttctttttttttttttttcttgttgttcttggtcagttattcaaaggaaaagggattgaaataaaaacttgcatgtgggatcgtacgtcgagtcgacctgcaggatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatgtctcctaagcggcaagctctgccaatcacaattgatggcgcaacttatgatgtgtctgcttgggtcaatcaccaccctggaggagctgacattatcgagaactatcgcaaccgcgatgcgaccgatgtcttcatggtgatgcactctcaagaagccgtcgccaagttgaagagaatgcctgttatggagccttcctctcctgacacacctgttgcacccaagcctaagcgtgatgagccccaggaggatttccgcaagttgcgggaggaattcatctccaagggtatgttcgagacgagtttcctttggtatttttacaagacttcaactaccgtcggtttgatggtcctttccatcttgatgaccgtgtacacgaattggtatttcaccgctgctttggttcttggcgtgtgctaccaacagctaggctggttgtcccacgactattgccatcaccaggttttcacaaaccgcaagattaacgacgctttcggtctctttttcggtaacgtgatgcagggatactcacagacttggtggaaggataggcacaatggtcaccatgccgccaccaatgtggtcggccatgacccagatattgataacctccccatcctggcttggtctcccgaagatgtcaagagggctactccttcgactcggaatctcatcaagtaccagcagtactacttcattcccaccattgcatcccttaggttcatctggtgcctccaatccatcggcggcgtcatgtcctacaagagcgaggagaggaacctgtactacaagcgccagtacactaaggaggcgattggtctggccctccactgggtgctcaaggccactttctattgcagtgccatgcctagctttgccaccggtttgggatgcttcttgatctccgagctgctcggaggatttggcattgccatcgttgtgtttctgaatcactatcctttggacaaggttgaggagactgtctgggatgagcacgggttcagcgccagccagatccacgagacgttgaacattaagcccggccttctcaccgattgggtctttggtggtctcaactaccagattgagcaccacttgtggcccaacatgcccaggcacaacctcacggcagcttccctggaggtgcagaagttgtgcgccaagcacaacctgccctacagggccccagccatcatccccggggttcagaaattggtcagcttcttaggcgagattgcccagctggctgctgtccctgaatgagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacctgca

SEQ ID NO: 168 - DNA, 5445 bp, Artificial Sequence
  plasmid pKR1127
ggccgcatttcgcaccaaatcaatgaaagtaataatgaaaagtctgaataagaatacttaggcttagatgcctttgttacttgtgtaaaataacttgagtcatgtacctttggcggaaacagaataaataaaaggtgaaattccaatgctctatgtataagttagtaatacttaatgtgttctacggttgtttcaatatcatcaaactctaattgaaactttagaaccacaaatctcaatcttttcttaatgaaatgaaaaatcttaattgtaccatgtttatgttaaacaccttacaattggttggagaggaggaccaaccgatgggacaacattgggagaaagagattcaatggagatttggataggagaacaacattctttttcacttcaatacaagatgagtgcaacactaaggatatgtatgagactttcagaagctacgacaacatagatgagtgaggtggtgattcctagcaagaaagacattagaggaagccaaaatcgaacaaggaagacatcaagggcaagagacaggaccatccatctcaggaaaaggagctttgggatagtccgagaagttgtacaagaaattttttggagggtgagtgatgcattgctggtgactttaactcaatcaaaattgagaaagaaagaaaagggagggggctcacatgtgaatagaagggaaacgggagaattttacagttttgatctaatgggcatcccagctagtggtaacatattcaccatgtttaaccttcacgtacgtctagaggatccccgggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcagcccgggggatccgccctaagcttcgtacgctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgcggccgcaccatgtctcctaagcggcaagctctgccaatcacaattgatggcgcaacttatgatgtgtctgcttgggtcaatcaccaccctggaggagctgacattatcgagaactatcgcaaccgcgatgcgaccgatgtcttcatggtgatgcactctcaagaagccgtcgccaagttgaagagaatgcctgttatggagccttcctctcctgacacacctgttgcacccaagcctaagcgtgatgagccccaggaggatttccgcaagttgcgggaggaattcatctccaagggtatgttcgagacgagtttcctttggtatttttacaagacttcaactaccgtcggtttgatggtcctttccatcttgatgaccgtgtacacgaattggtatttcaccgctgctttggttcttggcgtgtgctaccaacagctaggctggttgtcccacgactattgccatcaccaggttttcacaaaccgcaagattaacgacgctttcggtctctttttcggtaacgtgatgcagggatactcacagacttggtggaaggataggcacaatggtcaccatgccgccaccaatgtggtcggccatgacccagatattgataacctccccatcctggcttggtctcccgaagatgtcaagagggctactccttcgactcggaatctcatcaagtaccagcagtactacttcattcccaccattgcatcccttaggttcatctggtgcctccaatccatcggcggcgtcatgtcctacaagagcgaggagaggaacctgtactacaagcgccagtacactaaggaggcgattggtctggccctccactgggtgctcaaggccactttctattgcagtgccatgcctagctttgccaccggtttgggatgcttcttgatctccgagctgctcggaggatttggcattgccatcgttgtgtttctgaatcactatcctttggacaaggttgaggagactgtctgggatgagcacgggttcagcgccagccagatccacgagacgttgaacattaagcccggccttctcaccgattgggtctttggtggtctcaactaccagattgagcaccacttgtggcccaacatgcccaggcacaacctcacggcagcttccctggaggtgcagaagttgtgcgccaagcacaacctgccctacagggccccagccatcatccccggggttcagaaattggtcagcttcttaggcgagattgcccagctggctgctgtccctgaatgagc

SEQ ID NO: 169 - DNA, 9230 bp, Artificial Sequence
  plasmid pKR1129
  misc_feature (3748)..(3748): n is a, c, g, or t
gtacggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttggatctcctgcaggatctggccgggtacgtcctcgaagagaagggttaataacacattttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggccgcatgggaacggaccaaggaaaaaccttcacctgggaagagctggcggcccataacaccaaggacgacctactcttggccatccgcggcagggtgtacgatgtcacaaagttcttgagccgccatcctggtggagtggacactctcctgctcggagctggccgagatgttactccggtctttgagatgtatcacgcgtttggggctgcagatgccattatgaagaagtactatgtcggtacactggtctcgaatgagctgcccatcttcccggagccaacggtgttccacaaaaccatcaagacgagagtcgagggctactttacggatcggaacattgatcccaagaatagaccagagatctggggacgatacgctcttatctttggatccttgatcgcttcctactacgcgcagctctttgtgcctttcgttgtcgaacgcacatggcttcaggtggtgtttgcaatcatcatgggatttgcgtgcgcacaagtcggactcaaccctcttcatgatgcgtctcacttttcagtgacccacaaccccactgtctggaagattctgggagccacgcacgactttttcaacggagcatcgtacctggtgtggatgtaccaacatatgctcggccatcacccctacaccaacattgctggagcagatcccgacgtgtcgacgtctgagcccgatgttcgtcgtatcaagcccaaccaaaagtggtttgtcaaccacatcaaccagcacatgtttgttcctttcctgtacggactgctggcgttcaaggtgcgcattcaggacatcaacattttgtactttgtcaagaccaatgacgctattcgtgtcaatcccatctcgacatggcacactgtgatgttctggggcggcaaggctttctttgtctggtatcgcctgattgttcccctgcagtatctgcccctgggcaaggtgctgctcttgttcacggtcgcggacatggtgtcgtcttactggctggcgctgaccttccaggcgaaccacgttgttgaggaagttcagtggccgttgcctgacgagaacgggatcatccaaaaggactgggcagctatgcaggtcgagactacgcaggattacgcacacgattcgcacctctggaccagcatcactggcagcttgaactaccaggctgtgcaccatctgttccccaacgtgtcgcagcaccattatcccgatattctggccatcatcaagaacacctgcagcgagtacaaggttccataccttgtcaaggatacgttttggcaagcatttgcttcacatttggagcacttgcgtgttcttggactccgtcccaaggaagagtaggcggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccggtctagaggatccaaggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgcgtacccggccggatctcgtacgctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgcggccgcaccatgtctcctaagcggcaagctctgccaatcacaattgatggcgcaacttatgatgtgtctgcttgggtcaatcaccaccctggaggagctgacattatcgagaactatcgcaaccgcgatgcgaccgatgtcttcatggtgatgcactctcaagaagccgtcgccaagttgaagagaatgcctgttatggagccttcctctcctgacacacctgttgcacccaagcctaagcgtgatgagccccaggaggatttccgcaagttgcgggaggaattcatctccaagggtatgttcgagacgagtttcctttggtatttttacaagacttcaactaccgtcggtttgatggtcctttccatcttgatgaccgtgtacacgaattggtatttcaccgctgctttggttcttggcgtgtgctaccaacagctaggctggttgtcccacgactattgccatcaccaggttttcacaaaccgcaagattaacgacgctttcggtctctttttcggtaacgtgatgcagggatactcacagacttggtggaaggataggcacaatggtcaccatgccgccaccaatgtggtcggccatgacccagatattgataacctccccatcctggcttggtctcccgaagatgtcaagagggctactccttcgactcggaatctcatcaagtaccagcagtactacttcattcccaccattgcatcccttaggttcatctggtgcctccaatccatcggcggcgtcatgtcctacaagagcgaggagaggaacctgtactacaagcgccagtacactaaggaggcgattggtctggccctccactgggtgctcaaggccactttctattgcagtgccatgcctagctttgccaccggtttgggatgcttcttgatctccgagctgctcggaggatttggcattgccatcgttgtgtttctgaatcactatcctttggacaaggttgaggagactgtctgggatgagcacgggttcagcgccagccagatccacgagacgttgaacattaagcccggccttctcaccgattgggtctttggtggtctcaactaccagattgagcaccacttgtggcccaacatgcccaggcacaacctcacggcagcttccctggaggtgcagaagttgtgcgccaagcacaacctgccctacagggccccagccatcatccccggggttcagaaattggtcagcttcttaggcgagattgcccagctggctgctgtccctgaatgagcggccgcatttcgcaccaaatcaatgaaagtaataatgaaaagtctgaataagaatacttaggcttagatgcctttgttacttgtgtaaaataacttgagtcatgtacctttggcggaaacagaataaataaaaggtgaaattccaatgctctatgtataagttagtaatacttaatgtgttctacggttgtttcaatatcatcaaactctaattgaaactttagaaccacaaatctcaatcttttcttaatgaaatgaaaaatcttaattgtaccatgtttatgttaaacaccttacaattggttggagaggaggaccaaccgatgggacaacattgggagaaagagattcaatggagatttggataggagaacaacattctttttcacttcaatacaagatgagtgcaacactaaggatatgtatgagactttcagaagctacgacaacatagatgagtgaggtggtgattcctagcaagaaagacattagaggaagccaaaatcgaacaaggaagacatcaagggcaagagacaggaccatccatctcaggaaaaggagctttgggatagtccgagaagttgtacaagaaattttttggagggtgagtgatgcattgctggtgactttaactcaatcaaaattgagaaagaaagaaaagggagggggctcacatgtgaatagaagggaaacgggagaattttacagttttgatctaatgggcatcccagctagtggtaacatattcaccatgtttaaccttcac

SEQ ID NO: 170 - DNA, 11311 bp, Artificial Sequence
  plasmid pKR1132
  misc_feature (8035)..(8035): n is a, c, g, or t
ggagatccaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcagatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgtgaaggttaaacatggtgaatatgttaccactagctgggatgcccattagatcaaaactgtaaaattctcccgtttcccttctattcacatgtgagccccctcccttttctttctttctcaattttgattgagttaaagtcaccagcaatgcatcactcaccctccaaaaaatttcttgtacaacttctcggactatcccaaagctccttttcctgagatggatggtcctgtctcttgcccttgatgtcttccttgttcgattttggcttcctctaatgtctttcttgctaggaatcaccacctcactcatctatgttgtcgtagcttctgaaagtctcatacatatccttagtgttgcactcatcttgtattgaagtgaaaaagaatgttgttctcctatccaaatctccattgaatctctttctcccaatgttgtcccatcggttggtcctcctctccaaccaattgtaaggtgtttaacataaacatggtacaattaagatttttcatttcattaagaaaagattgagatttgtggttctaaagtttcaattagagtttgatgatattgaaacaaccgtagaacacattaagtattactaacttatacatagagcattggaatttcaccttttatttattctgtttccgccaaaggtacatgactcaagttattttacacaagtaacaaaggcatctaagcctaagtattcttattcagacttttcattattactttcattgatttggtgcgaaatgcggccgctcattcagggacagcagccagctgggcaatctcgcctaagaagctgaccaatttctgaaccccggggatgatggctggggccctgtagggcaggttgtgcttggcgcacaacttctgcacctccagggaagctgccgtgaggttgtgcctgggcatgttgggccacaagtggtgctcaatctggtagttgagaccaccaaagacccaatcggtgagaaggccgggcttaatgttcaacgtctcgtggatctggctggcgctgaacccgtgctcatcccagacagtctcctcaaccttgtccaaaggatagtgattcagaaacacaacgatggcaatgccaaatcctccgagcagctcggagatcaagaagcatcccaaaccggtggcaaagctaggcatggcactgcaatagaaagtggccttgagcacccagtggagggccagaccaatcgcctccttagtgtactggcgcttgtagtacaggttcctctcctcgctcttgtaggacatgacgccgccgatggattggaggcaccagatgaacctaagggatgcaatggtgggaatgaagtagtactgctggtacttgatgagattccgagtcgaaggagtagccctcttgacatcttcgggagaccaagccaggatggggaggttatcaatatctgggtcatggccgaccacattggtggcggcatggtgaccattgtgcctatccttccaccaagtctgtgagtatccctgcatcacgttaccgaaaaagagaccgaaagcgtcgttaatcttgcggtttgtgaaaacctggtgatggcaatagtcgtgggacaaccagcctagctgttggtagcacacgccaagaaccaaagcagcggtgaaataccaattcgtgtacacggtcatcaagatggaaaggaccatcaaaccgacggtagttgaagtcttgtaaaaataccaaaggaaactcgtctcgaacatacccttggagatgaattcctcccgcaacttgcggaaatcctcctggggctcatcacgcttaggcttgggtgcaacaggtgtgtcaggagaggaaggctccataacaggcattctcttcaacttggcgacggcttcttgagagtgcatcaccatgaagacatcggtcgcatcgcggttgcgatagttctcgataatgtcagctcctccagggtggtgattgacccaagcagacacatcataagttgcgccatcaattgtgattggcagagcttgccgcttaggagacatggtgcggccgcggtgatgactgatgagtgtttaaggaccaatggagagaatgtttgagttgtgaagcggagaacctgaggcgtggttatttatagggaagagaggaaggtgaatgagggacacgtcacagaagtagggtgctgagcttgagacattcttcagtatgcatggctatggaagccttgggtgctacacctcatgaagttcatggtgtgaggtggcttcggcatctcaattaagtgacaaagagaaaggtgtttcagtgtttctattgcaaatggcagaaactcgtgatgacgaggggaccatgcatggtttcatttcttttcttcctggattctttctttccttttatatatgcaggttcataatttaaaaattagactcgctttcaatttcttaatttctcattttcctcttatattactgtactaatgttaaccacgtacacttattttttttttagtttaattttgatagattgtgttgatttaaacatattaatattttcaaccaaataaaaatcattttagtagatacggctttttaaataattattaaaaatattaactatttatcctaaatggcacattttaattaaaaaaaatccggtgttgtaagtgttttattaatttgttttggcattattaaagcaactttttttttatttgttggcattttgagtacgtacttaggctagcgtacgagatccggccgggtacgcaaaggcaaagatttaaactcgaaaacattacaaaagtctcaaaacagaggcaaggccatgcacaaagcacactctaagtgcttccattgcctactaagtagggtacgtacacgatcaccattcaccagtgatgatctttattaatatacaacacactcagagacagcttatgttatagctagctagcataaactatcacatcatgtgttagtacgacaagtgacaacattgcttttaacttcgcggccttggatcctctagaccggatataatgagccgtaaacaaagatgattaagtagtaattaatacgtactagtaaaagtggcaaaagataacgagaaagaaccaatttctttgcattcggccttagcggaaggcatatataagctttgattattttatttagtgtaatgatttcgtacaaccaaagcatttatttagtactctcacacttgtgtcgcggccgcctactcttccttgggacggagtccaagaacacgcaagtgctccaaatgtgaagcaaatgcttgccaaaacgtatccttgacaaggtatggaaccttgtactcgctgcaggtgttcttgatgatggccagaatatcgggataatggtgctgcgacacgttggggaacagatggtgcacagcctggtagttcaagctgccagtgatgctggtccagaggtgcgaatcgtgtgcgtaatcctgcgtagtctcgacctgcatagctgcccagtccttttggatgatcccgttctcgtcaggcaacggccactgaacttcctcaacaacgtggttcgcctggaaggtcagcgccagccagtaagacgacaccatgtccgcgaccgtgaacaagagcagcaccttgcccaggggcagatactgcaggggaacaatcaggcgataccagacaaagaaagccttgccgccccagaacatcacagtgtgccatgtcgagatgggattgacacgaatagcgtcattggtcttgacaaagtacaaaatgttgatgtcctgaatgcgcaccttgaacgccagcagtccgtacaggaaaggaacaaacatgtgctggttgatgtggttgacaaaccacttttggttgggcttgatacgacgaacatcgggctcagacgtcgacacgtcgggatctgctccagcaatgttggtgtaggggtgatggccgagcatatgttggtacatccacaccaggtacgatgctccgttgaaaaagtcgtgcgtggctcccagaatcttccagacagtggggttgtgggtcactgaaaagtgagacgcatcatgaagagggttgagtccgacttgtgcgcacgcaaatcccatgatgattgcaaacaccacctgaagccatgtgcgttcgacaacgaaaggcacaaagagctgcgcgtagtaggaagcgatcaaggatccaaagataagagcgtatcgtccccagatctctggtctattcttgggatcaatgttccgatccgtaaagtagccctcgactctcgtcttgatggttttgtggaacaccgttggctccgggaagatgggcagctcattcgagaccagtgtaccgacatagtacttcttcataatggcatctgcagccccaaacgcgtgatacatctcaaagaccggagtaacatctcggccagctccgagcaggagagtgtccactccaccaggatggcggctcaagaactttgtgacatcgtacaccctgccgcggatggccaagagtaggtcgtccttggtgttatgggccgccagctcttcccaggtgaaggtttttccttggtccgttcccatgcggccgcttggggggctatggaagactttcttagttagttgtgtgaataagcaatgttgggagaatcgggactacttataggataggaataaaacagaaaagtattaagtgctaatgaaatatttagactgataattaaaatcttcacgtatgtccacttgatataaaaacgtcaggaataaaggaagtacagtagaatttaaaggtactctttttatatatacccgtgttctctttttggctagctagttgcataaaaaataatctatatttttatcattattttaaatatcttatgagatggtaaatatttatcataattttttttactattatttattatttgtgtgtgtaatacatatagaagttaattacaaattttatttactttttcattattttgatatgattcaccattaatttagtgttattatttataatagttcattttaatctttttgtatatattatgcgtgcagtacttttttcctacatataactactattacattttatttatataatatttttattaatgaattttcgtgataatatgtaatattgttcattattatttcagattttttaaaaatatttgtgttattatttatgaaatatgtaatttttttagtatttgattttatgatgataaagtgttctaaattcaaaagaagggggaaagcgtaaacattaaaaaacgtcatcaaacaaaaacaaaatcttgttaataaagataaaactgtttgttttgatcactgttatttcgtaatataaaaacattatttatatttatattgttgacaaccaaatttgcctatcaaatctaaccaatataatgcatgcgtggcaggtaatgtactaccatgaacttaagtcatgacataataaaccgtgaatctgaccaatgcatgtacctanctaaattgtatttgtgacacgaagcaaatgattcaattcacaatggagatgggaaacaaataatgaagaacccagaactaagaaagcttttctgaaaaataaaataaaggcaatgtcaaaagtatactgcatcatcagtccagaaagcacatgatatttttttatcagtatcaatgcagctagttttattttacaatatcgatatagctagtttaaatatattgcagctagatttataaatatttgtgttattatttatcatttgtgtaatcctgtttttagtattttagtttatatatgatgataatgtattccaaatttaaaagaagggaaataaatttaaacaagaaaaaaagtcatcaaacaaaaaacaaatgaaagggtggaaagatgttaccatgtaatgtgaatgttacagtatttcttttattatagagttaacaaattaactaatatgattttgttaataatgataaaatattttttttattattatttcataatataaaaatagtttacttaatataaaaaaaattctatcgttcacaacaaagttggccacctaatttaaccatgcatgtacccatggaccatattaggtaaccatcaaacctgatgaagagataaagagatgaagacttaagtcataacacaaaaccataaaaaacaaaaatacaatcaaccgtcaatctgaccaatgcatgaaaaagctgcaatagtgagtggcgacacaaagcacatgattttcttacaacggagataaaaccaaaaaaatatttcatgaacaacctagaacaaataaagcttttatataataaatatataaataaataaaggctatggaataatatacttcaatatatttggattaaataaattgttggcggggttgatatatttatacacacctaaagtcacttcaatctcattttcacttaacttttattttttttttctttttatttatcataaagagaatattgataatatactttttaacatatttttatgacattttttattggtgaaaacttattaaaaatcataaattttgtaagttagatttatttaaagagttcctcttcttattttaaattttttaataaatttttaaataactaaaatttgtgttaaaaatgttaaaaaatgtgttattaacccttctcttcgaggacgtacccggccagatcctgcaggccaactgcgtttggggctccagattaaacgacgccgtttcgttcctttcgcttcacggcttaacgatgtcgtttctgtctgtgcccaaaaaataaaggcatttgttatttgcaccagatatttactaagtgcaccctagtttgacaagtaggcgataattacaaatagatgcggtgcaaataataaattttgaaggaaataattacaaaagaacagaacttatatttactttattttaaaaaactaaaatgaaagaacaaaaaaagtaaaaaatacaaaaaatgtgctttaaccactttcattatttgttacagaaagtatgattctactcaaattgatctgttgtatctggtgctgccttgtcacactggcgatttcaatcccctaaagatatggtgcaaactgcgaagtgatcaatatctgctcggttaatttagattaattaataatattcaacgtgatgtaccaaaaaaagacaattttttgctccattgacaaattaaacctcatcaaggtaatttccaaacctataagcaaaaaaatttcacattaattggcccgcaatcctattagtcttattatactagagtaggaaaaaaaacaattacacaacttgtcttattattctctatgctaatgaatatttttcccttttgttagaaatcagtgtttcctaatttattgagtattaattccactcaccgcatatatttaccgttgaataagaaaattttacacataattctttttaagataaataatttttttatactagatcttatatgattacgtgaagccaagtgggttatactaatgatatataatgtttgatagtaatcagtttataaaccaaatgcatggaaatgttacgtggaagcacgtaaattaacaagcattgaagcaaatgcagccaccgcaccaaaaccaccccacttcacttccacgtaccatattccatgcaactacaacaccctaaaacttcaataaatgcccccaccttcacttcacttcacccatcaatagcaagcggccgcaccatggaggtggtgaatgaaatagtctcaattgggcaggaagttttacccaaagttgattatgcccaactctggagtgatgccagtcactgtgaggtgctttacttgtccatcgcatttgtcatcttgaagttcactcttggcccccttggtccaaaaggtcagtctcgtatgaagtttgttttcaccaattacaaccttctcatgtccatttattcgttgggatcattcctctcaatggcatatgccatgtacaccatcggtgttatgtctgacaactgcgagaaggcttttgacaacaacgtcttcaggatcaccacgcagttgttctatttgagcaagttcctggagtatattgactccttctatttgccactgatgggcaagcctctgacctggttgcaattcttccatcatttgggggcaccgatggatatgtggctgttctataattaccgaaatgaagctgtttggatttttgtgctgttgaatggtttcatccactggatcatgtacggttattattggaccagattgatcaagctgaagttccccatgccaaaatccctgattacatcaatgcagatcattcaattcaatgttggtttctacattgtctggaagtacaggaacattccctgttatcgccaagatgggatgaggatgtttggctggttcttcaattacttttatgttggcacagtcttgtgtttgttcttgaatttctatgtgcaaacgtatatcgtcaggaagcacaagggagccaaaaagattcagtgagcggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgcgtacaaacctgca

SEQ ID NO: 171 - DNA, 54 bp, Artificial Sequence
  oligonucleotide linker EgDHAsyn1Link
cccgcccgtccagctggactcccgccggccacgtactacgactccctggcagtg

SEQ ID NO: 172 - DNA, 22 bp, Artificial Sequence
  oligonucleotide MGW507
ggtaccatggaggtggtgaatg

SEQ ID NO: 173 - DNA, 30 bp, Artificial Sequence
  oligonucleotide MGW509
agctggacgggcgggctgaatctttttggc

SEQ ID NO: 174 - DNA, 30 bp, Artificial Sequence
  oligonucleotide MGW510
gccaaaaagattcagcccgcccgtccagct

SEQ ID NO: 175 - DNA, 31 bp, Artificial Sequence
  oligonucleotide MGW511
gaattcgcggccgctcactgccagggagtcg

SEQ ID NO: 176 - DNA, 839 bp, Artificial Sequence
  EgD9elo-EgDHAsyn1Link
ccatggaggtggtgaatgaaatagtctcaattgggcaggaagttttacccaaagttgattatgcccaactctggagtgatgccagtcactgtgaggtgctttacttgtccatcgcatttgtcatcttgaagttcactcttggcccccttggtccaaaaggtcagtctcgtatgaagtttgttttcaccaattacaaccttctcatgtccatttattcgttgggatcattcctctcaatggcatatgccatgtacaccatcggtgttatgtctgacaactgcgagaaggcttttgacaacaacgtcttcaggatcaccacgcagttgttctatttgagcaagttcctggagtatattgactccttctatttgccactgatgggcaagcctctgacctggttgcaattcttccatcatttgggggcaccgatggatatgtggctgttctataattaccgaaatgaagctgtttggatttttgtgctgttgaatggtttcatccactggatcatgtacggttattattggaccagattgatcaagctgaagttccccatgccaaaatccctgattacatcaatgcagatcattcaattcaatgttggtttctacattgtctggaagtacaggaacattccctgttatcgccaagatgggatgaggatgtttggctggttcttcaattacttttatgttggcacagtcttgtgtttgttcttgaatttctatgtgcaaacgtatatcgtcaggaagcacaagggagccaaaaagattcagcccgcccgtccagctggactcccgccggccacgtactacgactccctggcagtgagcggccgc

SEQ ID NO: 177 - DNA, 5213 bp, Artificial Sequence
  plasmid KS366
ctagaactagtggatccttcatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactccatggtgagagcgcggttcccattactgttgctgggagttgttttcctagcatcagtttctgtctcatttggcattgcgtattgggaaaagcagaaccccagtcacaacaagtgcctccgaagttgcaatagcgagaaagactcctacaggaaccaagcatgccacgctcgttgcaacctccttaaggtggaggaaatggttgagaaagagaaatgcaaacgcggtaagatcccacgtccacgtcctcgtccacagcacccagaacgtgaaccacagcagccaggtgagaaagaacgtgataaggatcgtcagccacgtccaatcccattccctcgtccacagccacgtcagaaagagaaacatgaacagcgtcgtgaacagaaatggccacgtaaagaagagaaacgcggtgagaaaggttctgaacgtgaaaagaaagacaaagatgaggaacaggatgaacgtcagttcccattcccggtggcggccgcaagtatgaactaaaatgcacgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaaggaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtaaagcaatggttgaccgtgtgcttagcttcttttattttatttttttatcagcaaagaataaataaaataaaatgagacacttcagggatgtttcaacggatcccccgggctgcaggaattcgatatcaagcttatcgataccgtcgacctcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccacc

SEQ ID NO: 178 - DNA, 5559 bp, Artificial Sequence
  DNA fragment EgD9elo-EgDHAsyn1Link
ggccgcaagtatgaactaaaatgcacgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaaggaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtaaagcaatggttgaccgtgtgcttagcttcttttattttatttttttatcagcaaagaataaataaaataaaatgagacacttcagggatgtttcaacggatcccccgggctgcaggaattcgatatcaagcttatcgataccgtcgacctcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccctagaactagtggatccttcatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactccatggaggtggtgaatgaaatagtctcaattgggcaggaagttttacccaaagttgattatgcccaactctggagtgatgccagtcactgtgaggtgctttacttgtccatcgcatttgtcatcttgaagttcactcttggcccccttggtccaaaaggtcagtctcgtatgaagtttgttttcaccaattacaaccttctcatgtccatttattcgttgggatcattcctctcaatggcatatgccatgtacaccatcggtgttatgtctgacaactgcgagaaggcttttgacaacaacgtcttcaggatcaccacgcagttgttctatttgagcaagttcctggagtatattgactccttctatttgccactgatgggcaagcctctgacctggttgcaattcttccatcatttgggggcaccgatggatatgtggctgttctataattaccgaaatgaagctgtttggatttttgtgctgttgaatggtttcatccactggatcatgtacggttattattggaccagattgatcaagctgaagttccccatgccaaaatccctgattacatcaatgcagatcattcaattcaatgttggtttctacattgtctggaagtacaggaacattccctgttatcgccaagatgggatgaggatgtttggctggttcttcaattacttttatgttggcacagtcttgtgtttgttcttgaatttctatgtgcaaacgtatatcgtcaggaagcacaagggagccaaaaagattcagcccgcccgtccagctggactcccgccggccacgtactacgactccctggcagtgagc

SEQ ID NO: 179 - DNA, 6842 bp, Artificial Sequence
  plasmid KS373
ggccgcaccatgggcaagggtggagacggcggcgcgcaggcggtgagcgggaccgacgcgtctctcgctgaggtgagctccgtcgatagcaagagcgtgcacgtcgtgctctacggcaagcgcgtggatgtcacaaagttccagaaggcacacccgggcgggagcaaggtgttccgcatcttccaggagcgcgacgcgacggagcagttcgagtcttaccactcgcccaaggccatcaagatgatggagggcatgctcaagaagtcggaggatgcgcccgcttccgtgcccctgccctcgcggtccaccatgggcacggagttcaaggagatgattgagcgccacaagagggctggtctctacgacccttgcccgttggacgagctgttcaagctcaccatcgtccttgcgcccatcttcgtgggcgcctatctcgtgcggagcggcgtctcgcccctcgcgggcgcgctctccatgggctttggcttctacctcgacggctggcttgctcacgactacctgcatcacgcagtcttcaagggctcggtcaacacgctcgtcaaggcgaacaacgccatgggatacgccctcggcttcctccagggctacgacgtggcctggtggcgcgcgcgccataacacgcaccacgtgtgcaccaacgaggatggttcggacccggacatcaagacggcgcccctgctcatctacgtgcgagagaacccgtccattgccaagcggctcaacttcttccagcgctggcagcagtactactatgtgccgaccatggccatcctcgacctctactggcgcctggagtccatcgcgtacgtggctgtgcgcctgcctaagatgtggatgcaggccgccgctcttgccgctcactacgcgctcctgtgctgggtcttcgcagcgcatctcaacctcatccctctcatgatggttgcacgcggcttcgcgacgggcatcgttgtctttgcaacccactatggtgaggacatcctcgaccgcgagcacgtcgagggcatgacgctcgtcgagcagaccgccaagacctcccgtaacatcacgggcggctggctagtgaacgtgctcacgggcttcatctccctgcagaccgagcatcacctcttccccatgatgcccaccggcaacctaatgactatccagcccgaggtacgcgacttcttcaagaagcatggcctcgagtaccgcgagggcaacctcttccagtgcgtgcaccagaacatcaaggctctcgccttcgagcacctcctccactgagcggccgcaagtatgaactaaaatgcacgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaaggaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtaaagcaatggttgaccgtgtgcttagcttcttttattttatttttttatcagcaaagaataaataaaataaaatgagacacttcagggatgtttcaacggatcccccgggctgcaggaattcgatatcaagcttatcgataccgtcgacctcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccctagaactagtggatccttcatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactccatggaggtggtgaatgaaatagtctcaattgggcaggaagttttacccaaagttgattatgcccaactctggagtgatgccagtcactgtgaggtgctttacttgtccatcgcatttgtcatcttgaagttcactcttggcccccttggtccaaaaggtcagtctcgtatgaagtttgttttcaccaattacaaccttctcatgtccatttattcgttgggatcattcctctcaatggcatatgccatgtacaccatcggtgttatgtctgacaactgcgagaaggcttttgacaacaacgtcttcaggatcaccacgcagttgttctatttgagcaagttcctggagtatattgactccttctatttgccactgatgggcaagcctctgacctggttgcaattcttccatcatttgggggcaccgatggatatgtggctgttctataattaccgaaatgaagctgtttggatttttgtgctgttgaatggtttcatccactggatcatgtacggttattattggaccagattgatcaagctgaagttccccatgccaaaatccctgattacatcaatgcagatcattcaattcaatgttggtttctacattgtctggaagtacaggaacattccctgttatcgccaagatgggatgaggatgtttggctggttcttcaattacttttatgttggcacagtcttgtgtttgttcttgaatttctatgtgcaaacgtatatcgtcaggaagcacaagggagccaaaaagattcagcccgcccgtccagctggactcccgccggccacgtactacgactccctggcagtgagc

SEQ ID NO: 180 - protein, 11 aa, Artificial Sequence
  conserved motif at C-terminal for C20elo domains
  misc_feature (4)..(5): Xaa can be any naturally occurring amino acid
  misc_feature (8)..(10): Xaa can be any naturally occurring amino acid
VLFXXFYXXXY

SEQ ID NO: 181 - DNA, 39 bp, Artificial Sequence
  SMART IV oligonucleotide
aagcagtggtatcaacgcagagtggccattacggccggg

SEQ ID NO: 182 - DNA, 37 bp, Artificial Sequence
  Adaptor Primer from Invitrogen 3'-RACE kit
ggccacgcgtcgactagtacttttttttttttttttt

SEQ ID NO: 183 - DNA, 912 bp, Euglena gracilis
  CDS (1)..(912): synthetic C20 elongase (codon-optimized for Yarrowia lipolytica)
atggctgactctcccgtcatcaacctctccaccatgtggaagcctctgtcgctcatggccttggatcttgctgttctgggacacgtctggaagcaggcacaacaggagggctccatctcggcttacgccgactctgtgtggactcccctcatcatgtccggtctgtacctctccatgatcttcgtgggatgtcgatggatgaagaaccgagagcccttcgaaatcaagacctacatgtttgcctacaacctgtaccagaccctcatgaacctttgcattgtgctgggcttcctctaccaggtccacgctaccggtatgcgattctggggatctggcgtggaccgatcgcccaagggtctgggaattggctttttcatctatgcccattaccacaacaagtacgtcgagtacttcgacacactcttcatggtgctgcggaaaaagaacaaccagatttcctttcttcacgtctaccatcacgctctgctcacctgggcttggtttgccgtggtctacttcgctcctggaggtgacggctggtttggagcctgctacaattcctccattcatgtcctgatgtactcttactatctgcttgccaccttcggcatctcctgtccctggaaaaagatcctcacccagctgcaaatggttcagttctgcttttgcttcacccactcgatctacgtgtggatttgcggttccgaaatctaccctcgacccttgactgctctccagtccttcgtgatggtcaacatgctggttctctttggcaacttctacgtcaagcagtattctcagaagaatggaaagcccgagaacggtgccactcctgagaacggtgccaagcctcagccctgcgagaacggcaccgtcgagaagcgagagaacgacactgccaacgttcgataa

SEQ ID NO: 184 - protein, 303 aa, Euglena gracilis
MADSPVINLSTMWKPLSLMALDLAVLGHVWKQAQQEGSISAYADSVWTPLIMSGLYLSMIFVGCRWMKNREPFEIKTYMFAYNLYQTLMNLCIVLGFLYQVHATGMRFWGSGVDRSPKGLGIGFFIYAHYHNKYVEYFDTLFMVLRKKNNQISFLHVYHHALLTWAWFAVVYFAPGGDGWFGACYNSSIHVLMYSYYLLATFGISCPWKKILTQLQMVQFCFCFTHSIYVWICGSEIYPRPLTALQSFVMVNMLVLFGNFYVKQYSQKNGKPENGATPENGAKPQPCENGTVEKRENDTANVR

SEQ ID NO: 185 - DNA, 3632 bp, Artificial Sequence
  Plasmid pEgC20ES
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacctcgcgaatgcatctagatccatggctgactctcccgtcatcaacctctccaccatgtggaagcctctgtcgctcatggccttggatcttgctgttctgggacacgtctggaagcaggcacaacaggagggctccatctcggcttacgccgactctgtgtggactcccctcatcatgtccggtctgtacctctccatgatcttcgtgggatgtcgatggatgaagaaccgagagcccttcgaaatcaagacctacatgtttgcctacaacctgtaccagaccctcatgaacctttgcattgtgctgggcttcctctaccaggtccacgctaccggtatgcgattctggggatctggcgtggaccgatcgcccaagggtctgggaattggctttttcatctatgcccattaccacaacaagtacgtcgagtacttcgacacactcttcatggtgctgcggaaaaagaacaaccagatttcctttcttcacgtctaccatcacgctctgctcacctgggcttggtttgccgtggtctacttcgctcctggaggtgacggctggtttggagcctgctacaattcctccattcatgtcctgatgtactcttactatctgcttgccaccttcggcatctcctgtccctggaaaaagatcctcacccagctgcaaatggttcagttctgcttttgcttcacccactcgatctacgtgtggatttgcggttccgaaatctaccctcgacccttgactgctctccagtccttcgtgatggtcaacatgctggttctctttggcaacttctacgtcaagcagtattctcagaagaatggaaagcccgagaacggtgccactcctgagaacggtgccaagcctcagccctgcgagaacggcaccgtcgagaagcgagagaacgacactgccaacgttcgataagcggccgcatcggatcccgggcccgtcgactgcagaggcctgcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 186 - protein, 4 aa, Euglena gracilis
KNGK

SEQ ID NO: 187 - protein, 5 aa, Euglena gracilis
PENGA

SEQ ID NO: 188 - DNA, 900 bp, Euglena anabaena
  CDS (1)..(900): synthetic C20 elongase (codon-optimized for Yarrowia lipolytica)
atggccgagggcaagtccgacggtcccgtcgttaccctccagtccatgtggaagcccctggctctcatggccatcgacgtcggcatcctggtcaacgtgcgacggaaggccttcaccgagttcgacggacactcgaacgtcttcgccgatcccgtgtacattccctttgtcatgaacctgttctacctcaccatgatctttgctggctgccgatggatgaagactcgagaacccttcgagatcaagtcctacatgtttgcctacaacgcttaccagacaatgatgaactttctcattgtggtcggcttcatgtatgaggttcactccaccggtatgcgatactggggatccagaatcgacacttctaccaagggcttgggactgggtttcctcatctatgcccattaccacaacaagtacgtggagtacgtcgacaccctgttcatgattctgcggaagaaaaacaatcagatctcgttccttcacgtttaccaccattccctgctcacttgggcatggtgggctgtggtctactgggctcctggcggagatgcctggttcggtgcctgttacaactccttcatccacgttctcatgtactcctactatctgtttgccaccttcggcattcgatgtccctggaaaaagatgctcacccagttgcaaatggtccagttctgcttttgcttcgctcatgccatgtacgttggatggcttggtcacgaggtgtaccctcgatggctcactgctctgcaggcctttgtgatgctcaacatgctggtcctctttggcaacttctacatgaagtcttactccaaggcgagcaagctcgaaccagcctctcccgtgtcgcctgcctctcttgctcagaagcccttcgagaacgccaaggtcaagtaa

SEQ ID NO: 189 - protein, 299 aa, Euglena anabaena
MAEGKSDGPVVTLQSMWKPLALMAIDVGILVNVRRKAFTEFDGHSNVFADPVYIPFVMNLFYLTMIFAGCRWMKTREPFEIKSYMFAYNAYQTMMNFLIVVGFMYEVHSTGMRYWGSRIDTSTKGLGLGFLIYAHYHNKYVEYVDTLFMILRKKNNQISFLHVYHHSLLTWAWWAVVYWAPGGDAWFGACYNSFIHVLMYSYYLFATFGIRCPWKKMLTQLQMVQFCFCFAHAMYVGWLGHEVYPRWLTALQAFVMLNMLVLFGNFYMKSYSKASKLEPASPVSPASLAQKPFENAKVK

SEQ ID NO: 190 - DNA, 3620 bp, Artificial Sequence
  Plasmid pEaC20ES
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacctcgcgaatgcatctagatccatggccgagggcaagtccgacggtcccgtcgttaccctccagtccatgtggaagcccctggctctcatggccatcgacgtcggcatcctggtcaacgtgcgacggaaggccttcaccgagttcgacggacactcgaacgtcttcgccgatcccgtgtacattccctttgtcatgaacctgttctacctcaccatgatctttgctggctgccgatggatgaagactcgagaacccttcgagatcaagtcctacatgtttgcctacaacgcttaccagacaatgatgaactttctcattgtggtcggcttcatgtatgaggttcactccaccggtatgcgatactggggatccagaatcgacacttctaccaagggcttgggactgggtttcctcatctatgcccattaccacaacaagtacgtggagtacgtcgacaccctgttcatgattctgcggaagaaaaacaatcagatctcgttccttcacgtttaccaccattccctgctcacttgggcatggtgggctgtggtctactgggctcctggcggagatgcctggttcggtgcctgttacaactccttcatccacgttctcatgtactcctactatctgtttgccaccttcggcattcgatgtccctggaaaaagatgctcacccagttgcaaatggtccagttctgcttttgcttcgctcatgccatgtacgttggatggcttggtcacgaggtgtaccctcgatggctcactgctctgcaggcctttgtgatgctcaacatgctggtcctctttggcaacttctacatgaagtcttactccaaggcgagcaagctcgaaccagcctctcccgtgtcgcctgcctctcttgctcagaagcccttcgagaacgccaaggtcaagtaagcggccgcatcggatcccgggcccgtcgactgcagaggcctgcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 191 - protein, 7 aa, Euglena gracilis
PCENGTV

SEQ ID NO: 192 - DNA, 1752 bp, Euglena anabaena
  CDS (1)..(1752): synthetic delta-4 desaturase (codon-optimized for Yarrowia lipolytica)
atggtcgttctcttcggcaacttctacatgaagtcttactccaaggcctcgaagctcgaacccgcttcccctgtgtctcccgcatccctggctcagaagccattcgagaacgccaaggtcaaacccggtggacctggcaagccctcggagatcgcttctcttccacctcccattcgacctgttggcaacccacctgcagcctattacgacgctctggccacctccggtactggacaggaccgaaagtttaccatgcgagaggtcgctcgacacattgttcccaccgatggctggttggcctgtcacgacggtgtgtacgacatcaccgagttcattggcaagcatcccggtggagatgttatctctctcggtctcggacgagactccactattctggtcgaatcgtaccatcctgcaggacgacccgacaaggttatggagaagtaccgaatcggtacacttcaggatcacagaaccttctacgactggcaggcctccgctttctacgccgagctcaagcagcgagtggttcagactctcaaggaggctggacaacctcgacgtggtggcctgtctgtcaaggcagcccttgttatggctgcctttgctgcctcgttctacctcatggtgacacagggatccttcttttgggctgccgtctggggtctggcaggctctcacattggactcagcatccagcacgacggcaatcatggtgctttctccaagtctggacgactcaaccgtcttgctggctggggtatggacgttatcggagcctcctcgactgcctgggagtaccaacacgtcattggtcatcaccagtacaccaacctggtgtccgatcccgagtttgctcttcccgagaacgatccagacgttttcggaacctatcccctcatgcggatgcatccggacactccttggaaaccccaccatcagctgcaacacgtgtacgcctttccgttgttcgctctcatgaccatcagcaaggtcattatctccgatttcacgttttgtcttgccaagcgacgtggtcccatcgacttctctgccagactcgttcccctcgagggtcagatgctgttctggggtgcaaagatcatgggctttctcatgcagattgtgcttccctgctacctgcatggcatcgctcacggattggccctcttcattacagctcatctggtttctggcgagtaccttgccgtctgtttcattatcaaccacatttccgagtcgtgcgactacctcaatccctcttccgttatcgctgcccgacggaccgaaatgctcaagcaggccgagcaggaagccaaggcgaaacagaagcaccccactccacctcccaacgactgggctgcctcccaagttctgtgttgcgtcaactggcgatctggtggctacttttcaaaccacctttctggtggactcaaccaccagatcgagcatcacctgtttcccagcatttctcacgccaactatcccaccattgctcctgttgtcaagggcgtgtgcgaggaatacggtcttccctacaagaactactctcagttttccgatgctctgtacggaatggtcgagcacttgcgagctatgggcaccaaacctgcagacaacgacaagcttgctcccactgcaggttccctggaggatgtttgtcctgtgctctctgctgccgttgctgcccaacccgacggctccaccgacggatctgctgccggttgtcctgctgtcgccactctggcttaa

SEQ ID NO: 193 - protein, 583 aa, Euglena anabaena
MVVLFGNFYMKSYSKASKLEPASPVSPASLAQKPFENAKVKPGGPGKPSEIASLPPPIRPVGNPPAAYYDALATSGTGQDRKFTMREVARHIVPTDGWLACHDGVYDITEFIGKHPGGDVISLGLGRDSTILVESYHPAGRPDKVMEKYRIGTLQDHRTFYDWQASAFYAELKQRVVQTLKEAGQPRRGGLSVKAALVMAAFAASFYLMVTQGSFFWAAVWGLAGSHIGLSIQHDGNHGAFSKSGRLNRLAGWGMDVIGASSTAWEYQHVIGHHQYTNLVSDPEFALPENDPDVFGTYPLMRMHPDTPWKPHHQLQHVYAFPLFALMTISKVIISDFTFCLAKRRGPIDFSARLVPLEGQMLFWGAKIMGFLMQIVLPCYLHGIAHGLALFITAHLVSGEYLAVCFIINHISESCDYLNPSSVIAARRTEMLKQAEQEAKAKQKHPTPPPNDWAASQVLCCVNWRSGGYFSNHLSGGLNHQIEHHLFPSISHANYPTIAPVVKGVCEEYGLPYKNYSQFSDALYGMVEHLRAMGTKPADNDKLAPTAGSLEDVCPVLSAAVAAQPDGSTDGSAAGCPAVATLA

SEQ ID NO: 194 - DNA, 1749 bp, Euglena anabaena
  CDS (1)..(1749): delta-4 desaturase gene domain of EaDHAsyn2 (i.e., corresponding to amino acids 259-841 of SEQ ID NO:96)
atgctggtgctgttcggcaacttctacatgaagtcgtactccaaggccagcaagctggagccggcctcccccgtgtcccccgcctccctcgcccagaagccgttcgagaacgccaaggtgaagcctgggggccccggcaagccaagcgagattgcgtcgctgccaccgccaattcgaccagtcgggaacccacctgcagcctactacgatgccctggcgacctcgggcaccgggcaggaccgcaagttcaccatgcgggaggtggcccgccatattgtgccgaccgatgggtggttggcgtgccatgacggtgtctacgacatcaccgagttcatagggaaacatcctggcggcgatgttatttctctcggattgggcagggactccacaatcctggttgagtcgtaccaccctgccggaaggccagacaaggtcatggaaaagtaccgcatcgggacgctccaggaccaccgcacgttctacgactggcaggcctccgcgttctacgccgagctgaagcagcgggtggtgcagacgctaaaggaggccggccaaccgcggcgtgggggcctgtcggtcaaagcggcgctggtcatggcggcgttcgcagcgtcgttctacctcatggtgacccagggatccttcttctgggccgccgtctggggcctcgccggctcccacattggcctcagcatccagcacgacgggaaccacggggctttcagtaagagtggtcggctgaaccgcctcgcgggctggggcatggacgtcatcggggcctcctcgacggcctgggagtaccagcacgtcatcgggcaccaccagtacaccaacctggtatcggatcccgagttcgcgctgcctgagaacgacccggacgtcttcggcacctatccgctgatgcggatgcatccggacaccccttggaagccgcaccaccagctgcagcatgtgtacgcgttcccgctgttcgccctgatgaccatcagcaaggtcatcatcagcgacttcacgttctgcctcgccaagcggcgcgggccgatcgacttctccgccaggctcgtgccacttgaggggcagatgctcttctggggggcgaagatcatggggttcctgatgcagatagtcctgccgtgctatctgcatggcatcgcccatgggctggcgctgttcatcacagcccacctggtgtcgggagagtacctcgcggtctgcttcatcatcaaccacatctctgagtcatgcgactatttgaatccaagttccgtcatcgctgcgcggaggacggaaatgctgaagcaggcggagcaggaggccaaggcaaagcagaagcaccccaccccaccgcccaacgactgggccgcgtctcaggtactgtgctgcgtaaactggcgctctggtggctatttctcaaaccacctctcaggcgggctgaaccaccagatcgagcaccacctcttccccagcatctcacatgcgaactatccgaccattgccccagttgtgaaaggggtgtgcgaggagtacggcctcccctacaagaactactcccagttctccgacgctctctatggaatggtggagcacctcagggcgatgggcacgaagccggcagacaacgacaagctggcgcccaccgcgggctccctggaggacgtgtgcccggtcttgagcgccgccgttgctgcccaacctgacggaagcaccgacggcagcgctgcgggttgtccagcagtagccacactggca

SEQ ID NO: 195 - protein, 583 aa, Euglena anabaena
MLVLFGNFYMKSYSKASKLEPASPVSPASLAQKPFENAKVKPGGPGKPSEIASLPPPIRPVGNPPAAYYDALATSGTGQDRKFTMREVARHIVPTDGWLACHDGVYDITEFIGKHPGGDVISLGLGRDSTILVESYHPAGRPDKVMEKYRIGTLQDHRTFYDWQASAFYAELKQRVVQTLKEAGQPRRGGLSVKAALVMAAFAASFYLMVTQGSFFWAAVWGLAGSHIGLSIQHDGNHGAFSKSGRLNRLAGWGMDVIGASSTAWEYQHVIGHHQYTNLVSDPEFALPENDPDVFGTYPLMRMHPDTPWKPHHQLQHVYAFPLFALMTISKVIISDFTFCLAKRRGPIDFSARLVPLEGQMLFWGAKIMGFLMQIVLPCYLHGIAHGLALFITAHLVSGEYLAVCFIINHISESCDYLNPSSVIAARRTEMLKQAEQEAKAKQKHPTPPPNDWAASQVLCCVNWRSGGYFSNHLSGGLNHQIEHHLFPSISHANYPTIAPVVKGVCEEYGLPYKNYSQFSDALYGMVEHLRAMGTKPADNDKLAPTAGSLEDVCPVLSAAVAAQPDGSTDGSAAGCPAVATLA

SEQ ID NO: 196 - DNA, 4472 bp, Artificial Sequence
  Plasmid pEaD4S
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacctcgcgaatgcatctagatccatggtcgttctcttcggcaacttctacatgaagtcttactccaaggcctcgaagctcgaacccgcttcccctgtgtctcccgcatccctggctcagaagccattcgagaacgccaaggtcaaacccggtggacctggcaagccctcggagatcgcttctcttccacctcccattcgacctgttggcaacccacctgcagcctattacgacgctctggccacctccggtactggacaggaccgaaagtttaccatgcgagaggtcgctcgacacattgttcccaccgatggctggttggcctgtcacgacggtgtgtacgacatcaccgagttcattggcaagcatcccggtggagatgttatctctctcggtctcggacgagactccactattctggtcgaatcgtaccatcctgcaggacgacccgacaaggttatggagaagtaccgaatcggtacacttcaggatcacagaaccttctacgactggcaggcctccgctttctacgccgagctcaagcagcgagtggttcagactctcaaggaggctggacaacctcgacgtggtggcctgtctgtcaaggcagcccttgttatggctgcctttgctgcctcgttctacctcatggtgacacagggatccttcttttgggctgccgtctggggtctggcaggctctcacattggactcagcatccagcacgacggcaatcatggtgctttctccaagtctggacgactcaaccgtcttgctggctggggtatggacgttatcggagcctcctcgactgcctgggagtaccaacacgtcattggtcatcaccagtacaccaacctggtgtccgatcccgagtttgctcttcccgagaacgatccagacgttttcggaacctatcccctcatgcggatgcatccggacactccttggaaaccccaccatcagctgcaacacgtgtacgcctttccgttgttcgctctcatgaccatcagcaaggtcattatctccgatttcacgttttgtcttgccaagcgacgtggtcccatcgacttctctgccagactcgttcccctcgagggtcagatgctgttctggggtgcaaagatcatgggctttctcatgcagattgtgcttccctgctacctgcatggcatcgctcacggattggccctcttcattacagctcatctggtttctggcgagtaccttgccgtctgtttcattatcaaccacatttccgagtcgtgcgactacctcaatccctcttccgttatcgctgcccgacggaccgaaatgctcaagcaggccgagcaggaagccaaggcgaaacagaagcaccccactccacctcccaacgactgggctgcctcccaagttctgtgttgcgtcaactggcgatctggtggctacttttcaaaccacctttctggtggactcaaccaccagatcgagcatcacctgtttcccagcatttctcacgccaactatcccaccattgctcctgttgtcaagggcgtgtgcgaggaatacggtcttccctacaagaactactctcagttttccgatgctctgtacggaatggtcgagcacttgcgagctatgggcaccaaacctgcagacaacgacaagcttgctcccactgcaggttccctggaggatgtttgtcctgtgctctctgctgccgttgctgcccaacccgacggctccaccgacggatctgctgccggttgtcctgctgtcgccactctggcttaagcggccgcatcggatcccgggcccgtcgactgcagaggcctgcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 197 - DNA, 54 bp, Euglena gracilis; identical to SEQ ID NO: 171

SEQ ID NO: 198 - protein, 18 aa, Euglena gracilis
PARPAGLPPATYYDSLAV

SEQ ID NO: 199 - DNA, 54 bp, Euglena gracilis
cccacccgtccagctggacccccgccggccacgtactacgactccctggcagtg

SEQ ID NO: 200 - protein, 18 aa, Euglena gracilis
PTRPAGPPPATYYDSLAV

SEQ ID NO: 201 - DNA, 909 bp, Euglena gracilis
atggcggatagcccagtcatcaacctcagcaccatgtggaaacccctttcactgatggctttggaccttgccgttttgggacatgtctggaagcaggcacaacaggagggcagcatttcggcctatgctgattctgtttggactcctctcattatgtccggtttatacttatcaatgatcttcgtggggtgccgctggatgaagaaccgtgaaccctttgagatcaaaacatacatgtttgcgtataacctgtatcagaccttgatgaacctttgcatcgtgttgggattcttgtaccaggtgcatgccactgggatgcgcttttggggaagtggtgtcgaccgaagcccaaaaggtttgggcattggcttcttcatttatgcccactaccacaacaagtatgtggaatattttgatacactttttatggtgctgcgaaagaagaacaaccagatttctttccttcacgtgtatcatcatgccctgttgacatgggcttggtttgctgttgtgtatttcgcacctggaggtgatggctggtttggagcttgctacaattcttccatccatgtcctgatgtactcttactacttgcttgcaacttttggcatcagttgcccatggaagaagatcttgacacagctccagatggttcaattctgtttctgttttacacattccatttatgtgtggatttgcgggtcagagatctacccacggcctctgactgctttgcagtcgttcgtgatggtcaatatgttggtgctgtttggcaatttctatgtcaagcaatactcccaaaagaacggcaagccggagaacggagccacccctgagaacggagcgaagccgcaaccttgcgagaacggcacggtggaaaagcgagagaatgacaccgccaacgttcgg

SEQ ID NO: 202 - protein, 303 aa, Euglena gracilis; identical to SEQ ID NO: 184

SEQ ID NO: 203 - DNA, 909 bp, Euglena gracilis
atggcggatagcccagtcatcaacctcagcaccatgtggaaacccctttcactgatggctttggaccttgccattttgggacatgtctggaagcaggcacaacaggagggcagcatttcggcctatgctgattctgtttggactcctctcattatgtccgttttatacttatcaatgatcttcgtggggtgccgctggatgaagaaccgtgaaccctttgagatcaaaacatacatgtttgcgtataacctgtatcagaccttgatgaacctttgcatcgtgttgggattcttgtaccaggtgcatgccactgggatgcgcttttggggaagtggtgtcgaccgaagcccgaaaggtttgggcattggcttcttcatttatgcccactaccacaacaagtatgtggaatattttgatacactttttatggtgctgcgaaagaagaacaaccagatttctttccttcacgtgtatcatcatgccctgttgacatgggcttggtttgctgttgtgtatttcgcacctggaggtgatggctggtttggagcttgctacaattcttccatccatgtcctgatgtactcttactacttgcttgcaacttttggcatcagttgcccatggaagaagatcttgacacagctccagatggttcaattctgtttctgttttacacattccatttatgtgtggatttgcgggtcagagatctacccacggcctctgactgctttgcagtcgttcgtgatggtcaatatgttggtgctgtttggcaatttctatgtcaagcaatactcccaaaagaacggcaagccggagaacggagccacccctgagaacggagcgaagccgcaaccttgcgagaacggcacggtggaaaagcgagagaatgacaccgccaacgttcgg

SEQ ID NO: 204 - protein, 303 aa, Euglena gracilis
MADSPVINLSTMWKPLSLMALDLAILGHVWKQAQQEGSISAYADSVWTPLIMSVLYLSMIFVGCRWMKNREPFEIKTYMFAYNLYQTLMNLCIVLGFLYQVHATGMRFWGSGVDRSPKGLGIGFFIYAHYHNKYVEYFDTLFMVLRKKNNQISFLHVYHHALLTWAWFAVVYFAPGGDGWFGACYNSSIHVLMYSYYLLATFGISCPWKKILTQLQMVQFCFCFTHSIYVWICGSEIYPRPLTALQSFVMVNMLVLFGNFYVKQYSQKNGKPENGATPENGAKPQPCENGTVEKRENDTANVR

SEQ ID NO: 205 - DNA, 2379 bp, Euglena gracilis
atggcggatagcccagtcatcaacctcagcaccatgtggaaacccctttcactgatggctttggaccttgccgttttgggacatgtctggaagcaggcacaacaggagggcagcatttcggcctatgctgattctgtttggactcctctcattatgtccggtttatacttatcaatgatcttcgtggggtgccgctggatgaagaaccgtgaaccctttgagatcaaaacatacatgtttgcgtataacctgtatcagaccttgatgaacctttgcatcgtgttgggattcttgtaccaggtgcatgccactgggatgcgcttttggggaagtggtgtcgaccgaagcccaaaaggtttgggcattggcttcttcatttatgcccactaccacaacaagtatgtggaatattttgatacactttttatggtgctgcgaaagaagaacaaccagatttctttccttcacgtgtatcatcatgccctgttgacatgggcttggtttgctgttgtgtatttcgcacctggaggtgatggctggtttggagcttgctacaattcttccatccatgtcctgatgtactcttactacttgcttgcaacttttggcatcagttgcccttggaagaagatcttgacacagctccagatggttcaattctgtttctgttttacacattccatttatgtgtggatttgcgggtcagagatctacccacggcctctgactgctttgcagtcgttcgtgatggtcaatatgttggtgctgtttggcaatttctatgtcaagcaatactcccaaaagaacggcaagccggagaacggagccacccctgagaacggagcgaagccgcaaccttgcgagaacggcacggtggaaaagcgagagaatgacaccgccaacgttcggcccgcccgtccagctggactcccgccggccacgtactacgactccctggcagtgtcggggcagggcaaggagcggctgttcaccaccgatgaggtgaggcggcacatcctccccaccgatggctggctgacgtgccacgaaggagtctacgatgtcactgatttccttgccaagcaccctggtggcggtgtcatcacgctgggccttggaagggactgcacaatcctcgtcgagtcataccaccctgctgggcgcccggacaaggtgatggagaagtaccgcattggtacgctgcaggaccccaagacgttctatgcttggggagagtccgatttctaccctgagttgaagcgccgggcccttgcaaggctgaaggaggctggtcaggcgcggcgcggcggccttggggtgaaggccctcctggtgctcaccctcttcttcgtgtcgtggtacatgtgggtggcccacaagtccttcctctgggccgccgtctggggcttcgccggctcccacgtcgggctgagcatccagcacgacggcaaccacggcgcgttcagccgcagcacactggtgaaccgcctggcggggtggggcatggacttgatcggcgcgtcgtcaacggtgtgggagtaccagcacgtcatcggccaccaccagtacaccaacctcgtgtcggacacgctattcagtctgcctgagaacgatccggacgtcttctccagctacccgctgatgcgcatgcacccggatacggcgtggcagccgcaccaccgcttccagcacctgttcgcgttcccactgttcgccctgatgacaatcagcaaggtgctgaccagcgatttcgctgtctgcctcagcatgaagaaggggtccatcgactgctcctccaggctcgtcccactggaggggcagctgctgttctggggggccaagctggcgaacttcctgttgcagattgtgttgccatgctacctccacgggacagctatgggcctggccctcttctctgttgcccaccttgtgtcgggggagtacctcgcgatctgcttcatcatcaaccacatcagcgagtcttgtgagtttatgaatacaagctttcaaaccgccgcccggaggacagagatgcttcaggcagcccatcaggcagcggaggccaagaaggtgaagcccacccctccaccgaacgattgggctgtgacacaggtccaatgctgcgtgaattggagatcaggtggcgtgttggccaatcacctctctggaggcttgaaccaccagatcgagcatcatctgttccccagcatctcgcatgccaactaccccatcatcgcccgtgttgtgaaggaggtgtgcgaggagtatgggttgccgtacaagaactacgtcacgttctgggatgcagtctgtggcatggttcagcacctccggttgatgggtgctccaccggtgccaacgaacggggacaaaaagtca

SEQ ID NO: 206 - DNA, 909 bp, Euglena gracilis
atggcggatagcccagtcatcaacctcagcaccatgtggaaacccctttcactgatggctttggaccttgccgttttgggacatgtctggaagcaggcacaacaggagggcagcatttcggcctatgctgattctgtttggactcctctcattatgtccggtttatacttatcaatgatcttcgtggggtgccgctggatgaagaaccgtgaaccctttgagatcaaaacatacatgtttgcgtataacctgtatcagaccttgatgaacctttgcatcgtgttgggattcttgtaccaggtgcatgccactgggatgcgcttttggggaagtggtgtcgaccgaagcccaaaaggtttgggcattggcttcttcatttatgcccactaccacaacaagtatgtggaatattttgatacactttttatggtgctgcgaaagaagaacaaccagatttctttccttcacgtgtatcatcatgccctgttgacatgggcttggtttgctgttgtgtatttcgcacctggaggtgatggctggtttggagcttgctacaattcttccatccatgtcctgatgtactcttactacttgcttgcaacttttggcatcagttgcccttggaagaagatcttgacacagctccagatggttcaattctgtttctgttttacacattccatttatgtgtggatttgcgggtcagagatctacccacggcctctgactgctttgcagtcgttcgtgatggtcaatatgttggtgctgtttggcaatttctatgtcaagcaatactcccaaaagaacggcaagccggagaacggagccacccctgagaacggagcgaagccgcaaccttgcgagaacggcacggtggaaaagcgagagaatgacaccgccaacgttcgg

SEQ ID NO: 207 - DNA, 975 bp, Euglena gracilis
atggcggatagcccagtcatcaacctcagcaccatgtggaaacccctttcactgatggctttggaccttgccgttttgggacatgtctggaagcaggcacaacaggagggcagcatttcggcctatgctgattctgtttggactcctctcattatgtccggtttatacttatcaatgatcttcgtggggtgccgctggatgaagaaccgtgaaccctttgagatcaaaacatacatgtttgcgtataacctgtatcagaccttgatgaacctttgcatcgtgttgggattcttgtaccaggtgcatgccactgggatgcgcttttggggaagtggtgtcgaccgaagcccaaaaggtttgggcattggcttcttcatttatgcccactaccacaacaagtatgtggaatattttgatacactttttatggtgctgcgaaagaagaacaaccagatttctttccttcacgtgtatcatcatgccctgttgacatgggcttggtttgctgttgtgtatttcgcacctggaggtgatggctggtttggagcttgctacaattcttccatccatgtcctgatgtactcttactacttgcttgcaacttttggcatcagttgcccttggaagaagatcttgacacagctccagatggttcaattctgtttctgttttacacattccatttatgtgtggatttgcgggtcagagatctacccacggcctctgactgctttgcagtcgttcgtgatggtcaatatgttggtgctgtttggcaatttctatgtcaagcaatactcccaaaagaacggcaagccggagaacggagccacccctgagaacggagcgaagccgcaaccttgcgagaacggcacggtggaaaagcgagagaatgacaccgccaacgttcggcccgcccgtccagctggactcccgccggccacgtactacgactccctggcagtgtcctgcaggacc

SEQ ID NO: 208 - protein, 325 aa, Euglena gracilis
MADSPVINLSTMWKPLSLMALDLAVLGHVWKQAQQEGSISAYADSVWTPLIMSGLYLSMIFVGCRWMKNREPFEIKTYMFAYNLYQTLMNLCIVLGFLYQVHATGMRFWGSGVDRSPKGLGIGFFIYAHYHNKYVEYFDTLFMVLRKKNNQISFLHVYHHALLTWAWFAVVYFAPGGDGWFGACYNSSIHVLMYSYYLLATFGISCPWKKILTQLQMVQFCFCFTHSIYVWICGSEIYPRPLTALQSFVMVNMLVLFGNFYVKQYSQKNGKPENGATPENGAKPQPCENGTVEKRENDTANVRPARPAGLPPATYYDSLAVSCRT

SEQ ID NO: 209 - DNA, 1299 bp, Isochrysis galbana
atgtgcaacgcggcgcaggtcgagacgcaggccttgcgcgccaaggaggcggcaaaaccgacgtggacgaagattcatgggcgcacagtcgacgtggagacgttccgccacccaggcggcaacatcctcgatttgttcctgggcatggatgccacaactgcctttgagacgttccacggtcaccacaagggagcatggaagatgctcaagacgctgcccgagaaggaggtcgccgccgccgacattcccgcgcagaaggaggagcacgtggccgagatgacacgcctcatggcctcatggcgcgagcgcgggctgttcaagccgcgtcccgtcgcctcatccatctatggcctgtgcgtgatcttcgccatcgcggcatcggtcgcgtgcgctccgtacgcgccagtgctggctggcatcgcggtgggcacctgctgggctcagtgcggcttcttgcagcacatgggcggccaccgggagtgggggcgcacttggtcgtttgcgtttcagcatctgtttgaaggcctgctcaagggcggctcggcctcgtggtggcgcaaccgccacaacaagcaccatgccaagaccaacgtgctcggcgaggacggcgacctgcgcaccacacccttcttcgcatgggaccctactctggccaagaaagtgcccgactggtctctgcgcacgcaagccttcacctttctgccagcactgggagcttacgtcttcgtctttgccttcacggtacgcaagtacagtgtggtgaagcgtctctggcacgaggtcgccctgatggtggcccactacgctctcttttcctgggcgctcagcgccgccggcgcctccctcagctccggcctcaccttctattgcaccgggtacgcctggcagggcatctacctcggcttcttcttcggcctatcgcactttgcggtggagcgcgtgccgtcgaccgccacctggctcgagtcgacgatgatgggcaccgttgactggggcggctcctccgccttctgcggctacctctccggcttcctcaatatccagatcgagcaccacatggctccacaaatgccaatggagaacctgcgccagatccgggccgactgcaaggccgcggcccacaagttcgggctgccgtaccgcgagctgacattcgtcgcggcgaccaagctcatgatgagcggcctctaccggaccggcaaggacgagctcaagctgcgcgcggaccgccgcaagttcacgagggcacaggcgtacatgggcgccgccagcgctttggtcgacacgctcaaggcggac

SEQ ID NO: 210 - DNA, 1299 bp, Isochrysis galbana
atggccctgcaggcgcaggtcgagacgcaggccttgcgcgccaaggaggcggcaaaaccgacgtggacgaagattcatgggcgcacagtcgacgtggagacgttccgccacccaggcggcaacatcctcgatttgttcctgggcatggatgccacaactgcctttgagacgttccacggtcaccacaagggagcatggaagatgctcaagacgctgcccgagaaggaggtcgccgccgccgacattcccgcgcagaaggaggagcacgtggccgagatgacacgcctcatggcctcatggcgcgagcgcgggctgttcaagccgcgtcccgtcgcctcatccatctatggcctgtgcgtgatcttcgccatcacggcatcggtcgcgtgcgctccgtacgcgccagtgctggctggcatcgcggtgggcacctgctgggctcagtgcggcttcttgcagcacatgggcggccaccgggagtgggggcgcacttggtcgtttgcgtttcagcatctgtttgaaggcctgctcaagggcggctcggcctcgtggtggcgcaaccgccacaacaagcaccatgccaagaccaacgtgctcggcgaggacggcgacctgcgcaccacacccttcttcgcatgggaccctactctggccaagaaagtgcccgactggtctctgcgcacgcaagccttcacctttctgccagcactgggagcttacgtcttcgtctttgccttcacggtacgcaagtacagtgtggtgaagcgtctctggcacgaggtcgccctgatggtggcccactacgctctcttttcctgggcgctcagcgccgccggcgcctccctcagctccggcctcaccttctattgcaccgggtacgcctggcagggcatctacctcggcttcttcttcggcctatcgcactttgcggtggagcgcgtgccgtcgaccgccacctggctcgagtcgacgatgatgggcaccgttgactggggcggctcctccgccttctgcggctacctctccggcttcctcaatatccagatcgagcaccacacggctccacaaatgccaatggagaacctgcgccagatccgggccgactgcaaggccgcggcccacaagttcgggctgccgtaccgcgagctgacattcgtcgcggcgaccaagctcatgatgagcggcctctaccggaccggcaaggacgagctcaagctgcgcgcggaccgccgcaagttcacgagggcacaggcgtacatgggcgccgccagcgctttggtcgacacgctcaaggcggac

SEQ ID NO: 211 - protein, 433 aa, Isochrysis galbana
MALQAQVETQALRAKEAAKPTWTKIHGRTVDVETFRHPGGNILDLFLGMDATTAFETFHGHHKGAWKMLKTLPEKEVAAADIPAQKEEHVAEMTRLMASWRERGLFKPRPVASSIYGLCVIFAITASVACAPYAPVLAGIAVGTCWAQCGFLQHMGGHREWGRTWSFAFQHLFEGLLKGGSASWWRNRHNKHHAKTNVLGEDGDLRTTPFFAWDPTLAKKVPDWSLRTQAFTFLPALGAYVFVFAFTVRKYSVVKRLWHEVALMVAHYALFSWALSAAGASLSSGLTFYCTGYAWQGIYLGFFFGLSHFAVERVPSTATWLESTMMGTVDWGGSSAFCGYLSGFLNIQIEHHTAPQMPMENLRQIRADCKAAAHKFGLPYRELTFVAATKLMMSGLYRTGKDELKLRADRRKFTRAQAYMGAASALVDTLKAD

SEQ ID NO: 212 - DNA, 2259 bp, Artificial Sequence
  in-frame fusion was made between the EgDHAsyn1C20EloDom3Linker and the IgD4*, separated by the proline-rich linker region (called EgDHAsyn1C20EloDom3-IgD4)
atggcggatagcccagtcatcaacctcagcaccatgtggaaacccctttcactgatggctttggaccttgccgttttgggacatgtctggaagcaggcacaacaggagggcagcatttcggcctatgctgattctgtttggactcctctcattatgtccggtttatacttatcaatgatcttcgtggggtgccgctggatgaagaaccgtgaaccctttgagatcaaaacatacatgtttgcgtataacctgtatcagaccttgatgaacctttgcatcgtgttgggattcttgtaccaggtgcatgccactgggatgcgcttttggggaagtggtgtcgaccgaagcccaaaaggtttgggcattggcttcttcatttatgcccactaccacaacaagtatgtggaatattttgatacactttttatggtgctgcgaaagaagaacaaccagatttctttccttcacgtgtatcatcatgccctgttgacatgggcttggtttgctgttgtgtatttcgcacctggaggtgatggctggtttggagcttgctacaattcttccatccatgtcctgatgtactcttactacttgcttgcaacttttggcatcagttgcccttggaagaagatcttgacacagctccagatggttcaattctgtttctgttttacacattccatttatgtgtggatttgcgggtcagagatctacccacggcctctgactgctttgcagtcgttcgtgatggtcaatatgttggtgctgtttggcaatttctatgtcaagcaatactcccaaaagaacggcaagccggagaacggagccacccctgagaacggagcgaagccgcaaccttgcgagaacggcacggtggaaaagcgagagaatgacaccgccaacgttcggcccgcccgtccagctggactcccgccggccacgtactacgactccctggcagtgtccctgcaggcgcaggtcgagacgcaggccttgcgcgccaaggaggcggcaaaaccgacgtggacgaagattcatgggcgcacagtcgacgtggagacgttccgccacccaggcggcaacatcctcgatttgttcctgggcatggatgccacaactgcctttgagacgttccacggtcaccacaagggagcatggaagatgctcaagacgctgcccgagaaggaggtcgccgccgccgacattcccgcgcagaaggaggagcacgtggccgagatgacacgcctcatggcctcatggcgcgagcgcgggctgttcaagccgcgtcccgtcgcctcatccatctatggcctgtgcgtgatcttcgccatcacggcatcggtcgcgtgcgctccgtacgcgccagtgctggctggcatcgcggtgggcacctgctgggctcagtgcggcttcttgcagcacatgggcggccaccgggagtgggggcgcacttggtcgtttgcgtttcagcatctgtttgaaggcctgctcaagggcggctcggcctcgtggtggcgcaaccgccacaacaagcaccatgccaagaccaacgtgctcggcgaggacggcgacctgcgcaccacacccttcttcgcatgggaccctactctggccaagaaagtgcccgactggtctctgcgcacgcaagccttcacctttctgccagcactgggagcttacgtcttcgtctttgccttcacggtacgcaagtacagtgtggtgaagcgtctctggcacgaggtcgccctgatggtggcccactacgctctcttttcctgggcgctcagcgccgccggcgcctccctcagctccggcctcaccttctattgcaccgggtacgcctggcagggcatctacctcggcttcttcttcggcctatcgcactttgcggtggagcgcgtgccgtcgaccgccacctggctcgagtcgacgatgatgggcaccgttgactggggcggctcctccgccttctgcggctacctctccggcttcctcaatatccagatcgagcaccacacggctccacaaatgccaatggagaacctgcgccagatccgggccgactgcaaggccgcggcccacaagttcgggctgccgtaccgcgagctgacattcgtcgcggcgaccaagctcatgatgagcggcctctaccggaccggcaaggacgagctcaagctgcgcgcggaccgccgcaagttcacgagggcacaggcgtacatgggcgccgccagcgctttggtcgacacgctcaaggcggac

SEQ ID NO: 213 - protein, 753 aa, Artificial Sequence
  the amino acid sequence for EgDHAsyn1C20EloDom3-IgD4
MADSPVINLSTMWKPLSLMALDLAVLGHVWKQAQQEGSISAYADSVWTPLIMSGLYLSMIFVGCRWMKNREPFEIKTYMFAYNLYQTLMNLCIVLGFLYQVHATGMRFWGSGVDRSPKGLGIGFFIYAHYHNKYVEYFDTLFMVLRKKNNQISFLHVYHHALLTWAWFAVVYFAPGGDGWFGACYNSSIHVLMYSYYLLATFGISCPWKKILTQLQMVQFCFCFTHSIYVWICGSEIYPRPLTALQSFVMVNMLVLFGNFYVKQYSQKNGKPENGATPENGAKPQPCENGTVEKRENDTANVRPARPAGLPPATYYDSLAVSLQAQVETQALRAKEAAKPTWTKIHGRTVDVETFRHPGGNILDLFLGMDATTAFETFHGHHKGAWKMLKTLPEKEVAAADIPAQKEEHVAEMTRLMASWRERGLFKPRPVASSIYGLCVIFAITASVACAPYAPVLAGIAVGTCWAQCGFLQHMGGHREWGRTWSFAFQHLFEGLLKGGSASWWRNRHNKHHAKTNVLGEDGDLRTTPFFAWDPTLAKKVPDWSLRTQAFTFLPALGAYVFVFAFTVRKYSVVKRLWHEVALMVAHYALFSWALSAAGASLSSGLTFYCTGYAWQGIYLGFFFGLSHFAVERVPSTATWLESTMMGTVDWGGSSAFCGYLSGFLNIQIEHHTAPQMPMENLRQIRADCKAAAHKFGLPYRELTFVAATKLMMSGLYRTGKDELKLRADRRKFTRAQAYMGAASALVDTLKAD

SEQ ID NO: 214 - DNA, 1416 bp, Euglena gracilis
tcggggcagggcaaggagcggctgttcaccaccgatgaggtgaggcggcacatcctccccaccgatggctggctgacgtgccacgaaggagtctacgatgtcactgatttccttgccaagcaccctggtggcggtgtcatcacgctgggccttggaagggactgcacaatcctcgtcgagtcataccaccctgctgggcgcccggacaaggtgatggagaagtaccgcattggtacgctgcaggaccccaagacgttctatgcttggggagagtccgatttctaccctgagttgaagcgccgggcccttgcaaggctgaaggaggctggtcaggcgcggcgcggcggccttggggtgaaggccctcctggtgctcaccctcttcttcgtgtcgtggtacatgtgggtggcccacaagtccttcctctgggccgccgtctggggcttcgccggctcccacgtcgggctgagcatccagcacgacggcaaccacggcgcgttcagccgcagcacactggtgaaccgcctggcggggtggggcatggacttgatcggcgcgtcgtcaacggtgtgggagtaccagcacgtcatcggccaccaccagtacaccaacctcgtgtcggacacgctattcagtctgcctgagaacgatccggacgtcttctccagctacccgctgatgcgcatgcacccggatacggcgtggcagccgcaccaccgcttccagcacctgttcgcgttcccactgttcgccctgatgacaatcagcaaggtgctgaccagcgatttcgctgtctgcctcagcatgaagaaggggtccatcgactgctcctccaggctcgtcccactggaggggcagctgctgttctggggggccaagctggcgaacttcctgttgcagattgtgttgccatgctacctccacgggacagctatgggcctggccctcttctctgttgcccaccttgtgtcgggggagtacctcgcgatctgcttcatcatcaaccacatcagcgagtcttgtgagtttatgaatacaagctttcaaaccgccgcccggaggacagagatgcttcaggcagcccatcaggcagcggaggccaagaaggtgaagcccacccctccaccgaacgattgggctgtgacacaggtccaatgctgcgtgaattggagatcaggtggcgtgttggccaatcacctctctggaggcttgaaccaccagatcgagcatcatctgttccccagcatctcgcatgccaactaccccatcatcgcccgtgttgtgaaggaggtgtgcgaggagtatgggttgccgtacaagaactacgtcacgttctgggatgcagtctgtggcatggttcagcacctccggttgatgggtgctccaccggtgccaacgaacggggacaaaaagtca

SEQ ID NO: 215 - protein, 472 aa, Euglena gracilis
SGQGKERLFTTDEVRRHILPTDGWLTCHEGVYDVTDFLAKHPGGGVITLGLGRDCTILVESYHPAGRPDKVMEKYRIGTLQDPKTFYAWGESDFYPELKRRALARLKEAGQARRGGLGVKALLVLTLFFVSWYMWVAHKSFLWAAVWGFAGSHVGLSIQHDGNHGAFSRSTLVNRLAGWGMDLIGASSTVWEYQHVIGHHQYTNLVSDTLFSLPENDPDVFSSYPLMRMHPDTAWQPHHRFQHLFAFPLFALMTISKVLTSDFAVCLSMKKGSIDCSSRLVPLEGQLLFWGAKLANFLLQIVLPCYLHGTAMGLALFSVAHLVSGEYLAICFIINHISESCEFMNTSFQTAARRTEMLQAAHQAAEAKKVKPTPPPNDWAVTQVQCCVNWRSGGVLANHLSGGLNHQIEHHLFPSISHANYPIIARVVKEVCEEYGLPYKNYVTFWDAVCGMVQHLRLMGAPPVPTNGDKKS

SEQ ID NO: 216 - DNA, 1419 bp, Euglena gracilis
atggccctgcagggcaaggagcggctgttcaccaccgatgaggtgaggcggcacatcctccccaccgatggctggctgacgtgccacgaaggagtctacgatgtcactgatttccttgccaagcaccctggtggcggtgtcatcacgctgggccttggaagggactgcacaatcctcgtcgagtcataccaccctgctgggcgcccggacaaggtgatggagaagtaccgcattggtacgctgcaggaccccaagacgttctatgcttggggagagtccgatttctaccctgagttgaagcgccgggcccttgcaaggctgaaggaggctggtcaggcgcggcgcggcggccttggggtgaaggccctcctggtgctcaccctcttcttcgtgtcgtggtacatgtgggtggcccacaagtccttcctctgggccgccgtctggggcttcgccggctcccacgtcgggctgagcatccagcacgacggcaaccacggcgcgttcagccgcagcacactggtgaaccgcctggcggggtggggcatggacttgatcggcgcgtcgtcaacggtgtgggagtaccagcacgtcatcggccaccaccagtacaccaacctcgtgtcggacacgctattcagtctgcctgagaacgatccggacgtcttctccagctacccgctgatgcgcatgcacccggatacggcgtggcagccgcaccaccgcttccagcacctgttcgcgttcccactgttcgccctgatgacaatcagcaaggtgctgaccagcgatttcgctgtctgcctcagcatgaagaaggggtccatcgactgctcctccaggctcgtcccactggaggggcagctgctgttctggggggccaagctggcgaacttcctgttgcagattgtgttgccatgctacctccacgggacagctatgggcctggccctcttctctgttgcccaccttgtgtcgggggagtacctcgcgatctgcttcatcatcaaccacatcagcgagtcttgtgagtttatgaatacaagctttcaaaccgccgcccggaggacagagatgcttcaggcagcccatcaggcagcggaggccaagaaggtgaagcccacccctccaccgaacgattgggctgtgacacaggtccaatgctgcgtgaattggagatcaggtggcgtgttggccaatcacctctctggaggcttgaaccaccagatcgagcatcatctgttccccagcatctcgcatgccaactaccccatcatcgcccgtgttgtgaaggaggtgtgcgaggagtatgggttgccgtacaagaactacgtcacgttctgggatgcagtctgtggcatggttcagcacctccggttgatgggtgctccaccggtgccaacgaacggggacaaaaagtca

SEQ ID NO: 217 - protein, 473 aa, Euglena gracilis
MALQGKERLFTTDEVRRHILPTDGWLTCHEGVYDVTDFLAKHPGGGVITLGLGRDCTILVESYHPAGRPDKVMEKYRIGTLQDPKTFYAWGESDFYPELKRRALARLKEAGQARRGGLGVKALLVLTLFFVSWYMWVAHKSFLWAAVWGFAGSHVGLSIQHDGNHGAFSRSTLVNRLAGWGMDLIGASSTVWEYQHVIGHHQYTNLVSDTLFSLPENDPDVFSSYPLMRMHPDTAWQPHHRFQHLFAFPLFALMTISKVLTSDFAVCLSMKKGSIDCSSRLVPLEGQLLFWGAKLANFLLQIVLPCYLHGTAMGLALFSVAHLVSGEYLAICFIINHISESCEFMNTSFQTAARRTEMLQAAHQAAEAKKVKPTPPPNDWAVTQVQCCVNWRSGGVLANHLSGGLNHQIEHHLFPSISHANYPIIARVVKEVCEEYGLPYKNYVTFWDAVCGMVQHLRLMGAPPVPTNGDKKS

SEQ ID NO: 218 - DNA, 2379 bp, Euglena gracilis
atggcggatagcccagtcatcaacctcagcaccatgtggaaacccctttcactgatggctttggaccttgccgttttgggacatgtctggaagcaggcacaacaggagggcagcatttcggcctatgctgattctgtttggactcctctcattatgtccggtttatacttatcaatgatcttcgtggggtgccgctggatgaagaaccgtgaaccctttgagatcaaaacatacatgtttgcgtataacctgtatcagaccttgatgaacctttgcatcgtgttgggattcttgtaccaggtgcatgccactgggatgcgcttttggggaagtggtgtcgaccgaagcccaaaaggtttgggcattggcttcttcatttatgcccactaccacaacaagtatgtggaatattttgatacactttttatggtgctgcgaaagaagaacaaccagatttctttccttcacgtgtatcatcatgccctgttgacatgggcttggtttgctgttgtgtatttcgcacctggaggtgatggctggtttggagcttgctacaattcttccatccatgtcctgatgtactcttactacttgcttgcaacttttggcatcagttgcccttggaagaagatcttgacacagctccagatggttcaattctgtttctgttttacacattccatttatgtgtggatttgcgggtcagagatctacccacggcctctgactgctttgcagtcgttcgtgatggtcaatatgttggtgctgtttggcaatttctatgtcaagcaatactcccaaaagaacggcaagccggagaacggagccacccctgagaacggagcgaagccgcaaccttgcgagaacggcacggtggaaaagcgagagaatgacaccgccaacgttcggcccgcccgtccagctggactcccgccggccacgtactacgactccctggcagtgtccctgcagggcaaggagcggctgttcaccaccgatgaggtgaggcggcacatcctccccaccgatggctggctgacgtgccacgaaggagtctacgatgtcactgatttccttgccaagcaccctggtggcggtgtcatcacgctgggccttggaagggactgcacaatcctcgtcgagtcataccaccctgctgggcgcccggacaaggtgatggagaagtaccgcattggtacgctgcaggaccccaagacgttctatgcttggggagagtccgatttctaccctgagttgaagcgccgggcccttgcaaggctgaaggaggctggtcaggcgcggcgcggcggccttggggtgaaggccctcctggtgctcaccctcttcttcgtgtcgtggtacatgtgggtggcccacaagtccttcctctgggccgccgtctggggcttcgccggctcccacgtcgggctgagcatccagcacgacggcaaccacggcgcgttcagccgcagcacactggtgaaccgcctggcggggtggggcatggacttgatcggcgcgtcgtcaacggtgtgggagtaccagcacgtcatcggccaccaccagtacaccaacctcgtgtcggacacgctattcagtctgcctgagaacgatccggacgtcttctccagctacccgctgatgcgcatgcacccggatacggcgtggcagccgcaccaccgcttccagcacctgttcgcgttcccactgttcgccctgatgacaatcagcaaggtgctgaccagcgatttcgctgtctgcctcagcatgaagaaggggtccatcgactgctcctccaggctcgtcccactggaggggcagctgctgttctggggggccaagctggcgaacttcctgttgcagattgtgttgccatgctacctccacgggacagctatgggcctggccctcttctctgttgcccaccttgtgtcgggggagtacctcgcgatctgcttcatcatcaaccacatcagcgagtcttgtgagtttatgaatacaagctttcaaaccgccgcccggaggacagagatgcttcaggcagcccatcaggcagcggaggccaagaaggtgaagcccacccctccaccgaacgattgggctgtgacacaggtccaatgctgcgtgaattggagatcaggtggcgtgttggccaatcacctctctggaggcttgaaccaccagatcgagcatcatctgttccccagcatctcgcatgccaactaccccatcatcgcccgtgttgtgaaggaggtgtgcgaggagtatgggttgccgtacaagaactacgtcacgttctgggatgcagtctgtggcatggttcagcacctccggttgatgggtgctccaccggtgccaacgaacggggacaaaaagtca

SEQ ID NO: 219 - protein, 793 aa, Euglena gracilis
MADSPVINLSTMWKPLSLMALDLAVLGHVWKQAQQEGSISAYADSVWTPLIMSGLYLSMIFVGCRWMKNREPFEIKTYMFAYNLYQTLMNLCIVLGFLYQVHATGMRFWGSGVDRSPKGLGIGFFIYAHYHNKYVEYFDTLFMVLRKKNNQISFLHVYHHALLTWAWFAVVYFAPGGDGWFGACYNSSIHVLMYSYYLLATFGISCPWKKILTQLQMVQFCFCFTHSIYVWICGSEIYPRPLTALQSFVMVNMLVLFGNFYVKQYSQKNGKPENGATPENGAKPQPCENGTVEKRENDTANVRPARPAGLPPATYYDSLAVSLQGKERLFTTDEVRRHILPTDGWLTCHEGVYDVTDFLAKHPGGGVITLGLGRDCTILVESYHPAGRPDKVMEKYRIGTLQDPKTFYAWGESDFYPELKRRALARLKEAGQARRGGLGVKALLVLTLFFVSWYMWVAHKSFLWAAVWGFAGSHVGLSIQHDGNHGAFSRSTLVNRLAGWGMDLIGASSTVWEYQHVIGHHQYTNLVSDTLFSLPENDPDVFSSYPLMRMHPDTAWQPHHRFQHLFAFPLFALMTISKVLTSDFAVCLSMKKGSIDCSSRLVPLEGQLLFWGAKLANFLLQIVLPCYLHGTAMGLALFSVAHLVSGEYLAICFIINHISESCEFMNTSFQTAARRTEMLQAAHQAAEAKKVKPTPPPNDWAVTQVQCCVNWRSGGVLANHLSGGLNHQIEHHLFPSISHANYPIIARVVKEVCEEYGLPYKNYVTFWDAVCGMVQHLRLMGAPPVPTNGDKKS

SEQ ID NO: 220 - DNA, 1623 bp, Euglena gracilis
atgttggtgctgtttggcaatttctatgtcaagcaatactcccaaaagaacggcaagccggagaacggagccacccctgagaacggagcgaagccgcaaccttgcgagaacggcacggtggaaaagcgagagaatgacaccgccaacgttcggcccgcccgtccagctggactcccgccggccacgtactacgactccctggcagtgtcggggcagggcaaggagcggctgttcaccaccgatgaggtgaggcggcacatcctccccaccgatggctggctgacgtgccacgaaggagtctacgatgtcactgatttccttgccaagcaccctggtggcggtgtcatcacgctgggccttggaagggactgcacaatcctcgtcgagtcataccaccctgctgggcgcccggacaaggtgatggagaagtaccgcattggtacgctgcaggaccccaagacgttctatgcttggggagagtccgatttctaccctgagttgaagcgccgggcccttgcaaggctgaaggaggctggtcaggcgcggcgcggcggccttggggtgaaggccctcctggtgctcaccctcttcttcgtgtcgtggtacatgtgggtggcccacaagtccttcctctgggccgccgtctggggcttcgccggctcccacgtcgggctgagcatccagcacgacggcaaccacggcgcgttcagccgcagcacactggtgaaccgcctggcggggtggggcatggacttgatcggcgcgtcgtcaacggtgtgggagtaccagcacgtcatcggccaccaccagtacaccaacctcgtgtcggacacgctattcagtctgcctgagaacgatccggacgtcttctccagctacccgctgatgcgcatgcacccggatacggcgtggcagccgcaccaccgcttccagcacctgttcgcgttcccactgttcgccctgatgacaatcagcaaggtgctgaccagcgatttcgctgtctgcctcagcatgaagaaggggtccatcgactgctcctccaggctcgtcccactggaggggcagctgctgttctggggggccaagctggcgaacttcctgttgcagattgtgttgccatgctacctccacgggacagctatgggcctggccctcttctctgttgcccaccttgtgtcgggggagtacctcgcgatctgcttcatcatcaaccacatcagcgagtcttgtgagtttatgaatacaagctttcaaaccgccgcccggaggacagagatgcttcaggcagcccatcaggcagcggaggccaagaaggtgaagcccacccctccaccgaacgattgggctgtgacacaggtccaatgctgcgtgaattggagatcaggtggcgtgttggccaatcacctctctggaggcttgaaccaccagatcgagcatcatctgttccccagcatctcgcatgccaactaccccatcatcgcccgtgttgtgaaggaggtgtgcgaggagtatgggttgccgtacaagaactacgtcacgttctgggatgcagtctgtggcatggttcagcacctccggttgatgggtgctccaccggtgccaacgaacggggacaaaaagtca

SEQ ID NO: 221 - protein, 541 aa, Euglena gracilis
MLVLFGNFYVKQYSQKNGKPENGATPENGAKPQPCENGTVEKRENDTANVRPARPAGLPPATYYDSLAVSGQGKERLFTTDEVRRHILPTDGWLTCHEGVYDVTDFLAKHPGGGVITLGLGRDCTILVESYHPAGRPDKVMEKYRIGTLQDPKTFYAWGESDFYPELKRRALARLKEAGQARRGGLGVKALLVLTLFFVSWYMWVAHKSFLWAAVWGFAGSHVGLSIQHDGNHGAFSRSTLVNRLAGWGMDLIGASSTVWEYQHVIGHHQYTNLVSDTLFSLPENDPDVFSSYPLMRMHPDTAWQPHHRFQHLFAFPLFALMTISKVLTSDFAVCLSMKKGSIDCSSRLVPLEGQLLFWGAKLANFLLQIVLPCYLHGTAMGLALFSVAHLVSGEYLAICFIINHISESCEFMNTSFQTAARRTEMLQAAHQAAEAKKVKPTPPPNDWAVTQVQCCVNWRSGGVLANHLSGGLNHQIEHHLFPSISHANYPIIARVVKEVCEEYGLPYKNYVTFWDAVCGMVQHLRLMGAPPVPTNGDKKS

SEQ ID NO: 222 - DNA, 1530 bp, Schizochytrium aggregatum
atgacggtgggcggcgatgaggtgtacagcatggcgcaggtgcgcgaccacaacaccccggacgacgcctggtgcgccatccacggcgaggtgtacgagctgaccaagttcgcccgcacccaccccgggggggacatcatcttgctggccgccggcaaggaggccaccatcctgttcgagacgtaccacgtgcgccccatctccgacgcggtcctgcgcaagtaccgcatcggcaagctcgccgccgccggcaaggatgagccggccaacgacagcacctactacagctgggacagcgacttttacaaggtgctccgccagcgtgtcgtggcgcgcctcgaggagcgcaagatcgcccgccgcggcggccccgagatctggatcaaggccgccatcctcgtcagcggcttctggtccatgctctacctcatgtgcaccctggacccgaaccgcggcgccatcctggccgccatcgcgctgggcatcgtcgccgccttcgtcggcacgtgcattcagcacgacggcaaccacggcgcgttcgccttctctccgttcatgaacaagctctctggctggacgctcgacatgatcggcgccagtgccatgacctgggagatgcagcacgtgctgggccaccacccgtacaccaacctgatcgagatggagaacggcacccaaaaggtcacccacgccgacgtcgaccccaagaaggccgaccaggagagcgacccggacgtcttcagcacctaccccatgctccgtctgcacccgtggcaccgcaagcgcttctaccaccgcttccagcacctgtacgcgccgctgctcttcggtttcatgaccatcaacaaggtgatcacccaggatgtgggagttgtcctcagcaagcgtctgtttcagatcgatgccaactgccgttacgccagcaagtcgtacgttgcgcgcttctggatcatgaagctgctcaccgtcctctacatggtcgccctccccgtgtacacccagggccttgtcgacgggctcaagctcttcttcatcgcccacttttcgtgcggcgagctgctggccaccatgttcatcgtcaaccacatcatcgagggcgtctcgtacgcctccaaggactctgtcaagggcaccatggcgccgccgcgcacggtgcacggcgtgaccccgatgcatgacacccgcgacgcgctcggcaaggagaaggcagccaccaagcacgtgccgctcaacgactgggccgcggtccagtgccagacctcggtcaactggtcgatcggctcgtggttctggaaccacttctccggcgggctcaaccaccagatcgagcaccacctcttccccggcctcacccacaccacctacgtgtacattcaggatgtggtgcaggcgacgtgcgccgagtacggggtcccgtaccagtcggagcagagcctcttctccgcctacttcaagatgctctcccaccttcgggcgctcggcaacgagccgatgccctcgtgggagaaggaccaccccaagtccaagtga

SEQ ID NO: 223 - DNA, 1530 bp, Schizochytrium aggregatum
atggccctgcagggcggcgatgaggtgtacagcatggcgcaggtgcgcgaccacaacaccccggacgacgcctggtgcgccatccacggcgaggtgtacgagctgaccaagttcgcccgcacccaccccgggggggacatcatcttgctggccgccggcaaggaggccaccatcctgttcgagacgtaccacgtgcgccccatctccgacgcggtcctgcgcaagtaccgcatcggcaagctcgccgccgccggcaaggatgagccggccaacgacagcacctactacagctgggacagcgacttttacaaggtgctccgccagcgtgtcgtggcgcgtctcgaggagcgcaagatcgcccgccgcggcggccccgagatctggatcaaggccgccatcctcgtcagcggcttctggtccatgctctacctcatgtgcaccctggacccgaaccgcggcgccatcctggccgccatcgcgctgggcatcgtcgccgccttcgtcggcacgtgcattcagcacgacggcaaccacggcgcgttcgccttctctccgttcatgaacaagctctctggctggacgctcgacatgatcggcgccagtgccatgacctgggagatgcagcacgtgctgggccaccacccgtacaccaacctgatcgagatggagaacggcacccaaaaggtcacccacgccgacgtcgaccccaagaaggccgaccaggagagcgacccggacgtcttcagcacctaccccatgctccgtctgcacccgtggcaccgcaagcgcttctaccaccgcttccagcacctgtacgcgccgctgctcttcggtttcatgaccatcaacaaggtgatcacccaggatgtgggagttgtcctcagcaagcgtctgtttcagatcgatgccaactgccgttacgccagcaagtcgtacgttgcgcgcttctggatcatgaagctgctcaccgtcctctacatggtcgccctccccgtgtacacccagggccttgtcgacgggctcaagctcttcttcatcgcccacttttcgtgcggcgagctgctggccaccatgttcatcgtcaaccacatcatcgagggcgtctcgtacgcctccaaggactctgtcaagggcaccatggcgccgccgcgcacggtgcacggcgtgaccccgatgcatgacacccgcgacgcgctcggcaaggagaaggcagccaccaagcacgtgccgctcaacgactgggccgcggtccagtgccagacctcggtcaactggtcgatcggctcgtggttctggaaccacttctccggcgggctcaaccaccagatcgagcaccacctcttccccggcctcacccacaccacctacgtgtacattcaggatgtggtgcaggcgacgtgcgccgagtacggggtcccgtaccagtcggagcagagcctcttctccgcctacttcaagatgctctcccaccttcgggcgctcggcaacgagccgatgccctcgtgggagaaggaccaccccaagtccaag

SEQ ID NO: 224 - protein, 510 aa, Schizochytrium aggregatum
MALQGGDEVYSMAQVRDHNTPDDAWCAIHGEVYELTKFARTHPGGDIILLAAGKEATILFETYHVRPISDAVLRKYRIGKLAAAGKDEPANDSTYYSWDSDFYKVLRQRVVARLEERKIARRGGPEIWIKAAILVSGFWSMLYLMCTLDPNRGAILAAIALGIVAAFVGTCIQHDGNHGAFAFSPFMNKLSGWTLDMIGASAMTWEMQHVLGHHPYTNLIEMENGTQKVTHADVDPKKADQESDPDVFSTYPMLRLHPWHRKRFYHRFQHLYAPLLFGFMTINKVITQDVGVVLSKRLFQIDANCRYASKSYVARFWIMKLLTVLYMVALPVYTQGLVDGLKLFFIAHFSCGELLATMFIVNHIIEGVSYASKDSVKGTMAPPRTVHGVTPMHDTRDALGKEKAATKHVPLNDWAAVQCQTSVNWSIGSWFWNHFSGGLNHQIEHHLFPGLTHTTYVYIQDVVQATCAEYGVPYQSEQSLFSAYFKMLSHLRALGNEPMPSWEKDHPKSK

SEQ ID NO: 225 - DNA, 2490 bp, Artificial Sequence
  in-frame fusion was made between the EgDHAsyn1C20EloDom3 and the SaD4*, separated by the proline-rich linker region (EgDHAsyn1C20EloDom3-SaD4)
atggcggatagcccagtcatcaacctcagcaccatgtggaaacccctttcactgatggctttggaccttgccgttttgggacatgtctggaagcaggcacaacaggagggcagcatttcggcctatgctgattctgtttggactcctctcattatgtccggtttatacttatcaatgatcttcgtggggtgccgctggatgaagaaccgtgaaccctttgagatcaaaacatacatgtttgcgtataacctgtatcagaccttgatgaacctttgcatcgtgttgggattcttgtaccaggtgcatgccactgggatgcgcttttggggaagtggtgtcgaccgaagcccaaaaggtttgggcattggcttcttcatttatgcccactaccacaacaagtatgtggaatattttgatacactttttatggtgctgcgaaagaagaacaaccagatttctttccttcacgtgtatcatcatgccctgttgacatgggcttggtttgctgttgtgtatttcgcacctggaggtgatggctggtttggagcttgctacaattcttccatccatgtcctgatgtactcttactacttgcttgcaacttttggcatcagttgcccttggaagaagatcttgacacagctccagatggttcaattctgtttctgttttacacattccatttatgtgtggatttgcgggtcagagatctacccacggcctctgactgctttgcagtcgttcgtgatggtcaatatgttggtgctgtttggcaatttctatgtcaagcaatactcccaaaagaacggcaagccggagaacggagccacccctgagaacggagcgaagccgcaaccttgcgagaacggcacggtggaaaagcgagagaatgacaccgccaacgttcggcccgcccgtccagctggactcccgccggccacgtactacgactccctggcagtgtccctgcagggcggcgatgaggtgtacagcatggcgcaggtgcgcgaccacaacaccccggacgacgcctggtgcgccatccacggcgaggtgtacgagctgaccaagttcgcccgcacccaccccgggggggacatcatcttgctggccgccggcaaggaggccaccatcctgttcgagacgtaccacgtgcgccccatctccgacgcggtcctgcgcaagtaccgcatcggcaagctcgccgccgccggcaaggatgagccggccaacgacagcacctactacagctgggacagcgacttttacaaggtgctccgccagcgtgtcgtggcgcgtctcgaggagcgcaagatcgcccgccgcggcggccccgagatctggatcaaggccgccatcctcgtcagcggcttctggtccatgctctacctcatgtgcaccctggacccgaaccgcggcgccatcctggccgccatcgcgctgggcatcgtcgccgccttcgtcggcacgtgcattcagcacgacggcaaccacggcgcgttcgccttctctccgttcatgaacaagctctctggctggacgctcgacatgatcggcgccagtgccatgacctgggagatgcagcacgtgctgggccaccacccgtacaccaacctgatcgagatggagaacggcacccaaaaggtcacccacgccgacgtcgaccccaagaaggccgaccaggagagcgacccggacgtcttcagcacctaccccatgctccgtctgcacccgtggcaccgcaagcgcttctaccaccgcttccagcacctgtacgcgccgctgctcttcggtttcatgaccatcaacaaggtgatcacccaggatgtgggagttgtcctcagcaagcgtctgtttcagatcgatgccaactgccgttacgccagcaagtcgtacgttgcgcgcttctggatcatgaagctgctcaccgtcctctacatggtcgccctccccgtgtacacccagggccttgtcgacgggctcaagctcttcttcatcgcccacttttcgtgcggcgagctgctggccaccatgttcatcgtcaaccacatcatcgagggcgtctcgtacgcctccaaggactctgtcaagggcaccatggcgccgccgcgcacggtgcacggcgtgaccccgatgcatgacacccgcgacgcgctcggcaaggagaaggcagccaccaagcacgtgccgctcaacgactgggccgcggtccagtgccagacctcggtcaactggtcgatcggctcgtggttctggaaccacttctccggcgggctcaaccaccagatcgagcaccacctcttccccggcctcacccacaccacctacgtgtacattcaggatgtggtgcaggcgacgtgcgccgagtacggggtcccgtaccagtcggagcagagcctcttctccgcctacttcaagatgctctcccaccttcgggcgctcggcaacgagccgatgccctcgtgggagaaggaccaccccaagtccaag

SEQ ID NO: 226 - protein, 830 aa, Artificial Seqeunce
  rhe amino acid sequence for EgDHAsyn1C20EloDom3-SaD4
MADSPVINLSTMWKPLSLMALDLAVLGHVWKQAQQEGSISAYADSVWTPLIMSGLYLSMIFVGCRWMKNREPFEIKTYMFAYNLYQTLMNLCIVLGFLYQVHATGMRFWGSGVDRSPKGLGIGFFIYAHYHNKYVEYFDTLFMVLRKKNNQISFLHVYHHALLTWAWFAVVYFAPGGDGWFGACYNSSIHVLMYSYYLLATFGISCPWKKILTQLQMVQFCFCFTHSIYVWICGSEIYPRPLTALQSFVMVNMLVLFGNFYVKQYSQKNGKPENGATPENGAKPQPCENGTVEKRENDTANVRPARPAGLPPATYYDSLAVSLQGGDEVYSMAQVRDHNTPDDAWCAIHGEVYELTKFARTHPGGDIILLAAGKEATILFETYHVRPISDAVLRKYRIGKLAAAGKDEPANDSTYYSWDSDFYKVLRQRVVARLEERKIARRGGPEIWIKAAILVSGFWSMLYLMCTLDPNRGAILAAIALGIVAAFVGTCIQHDGNHGAFAFSPFMNKLSGWTLDMIGASAMTWEMQHVLGHHPYTNLIEMENGTQKVTHADVDPKKADQESDPDVFSTYPMLRLHPWHRKRFYHRFQHLYAPLLFGFMTINKVITQDVGVVLSKRLFQIDANCRYASKSYVARFWIMKLLTVLYMVALPVYTQGLVDGLKLFFIAHFSCGELLATMFIVNHIIEGVSYASKDSVKGTMAPPRTVHGVTPMHDTRDALGKEKAATKHVPLNDWAAVQCQTSVNWSIGSWFWNHFSGGLNHQIEHHLFPGLTHTTYVYIQDVVQATCAEYGVPYQSEQSLFSAYFKMLSHLRALGNEPMPSWEKDHPKSK

SEQ ID NO: 227 - DNA, 897 bp, Euglena anabaena
atggccgaaggcaagagcgatgggcctgtggtgacccttcaaagcatgtggaaaccgcttgctttgatggcagtagatgtcggcatattggtcaatgtccgccgcaaggctttcactgagtttgatgggcacagcaacgtttttgcagatccagtttacattccatttgtgatgaatctcttctacttgaccatgatctttgctgggtgccgttggatgaagactcgcgagccctttgagatcaagtcatatatgtttgcatacaatgcatatcagacaatgatgaacttcctcattgtcgtcgggttcatgtatgaggtgcacagcacagggatgcgatattgggggtccaggatcgacacctccaccaagggcttgggcctcggtttcctgatctatgcccactaccacaacaaatatgtggagtatgtcgacacgttgttcatgatcctgcgcaagaaaaacaaccagatctcgttcctccacgtctaccaccattcgcttttgacttgggcctggtgggccgtggtctactgggccccgggaggagatgcctggttcggagcatgctacaattccttcatccacgtgctgatgtactcctactacctgtttgcaacgtttggcatcaggtgcccctggaagaagatgctgacccagttgcagatggtgcaattctgcttctgctttgcccacgcgatgtatgttggatggctgggccatgaagtctacccgcgctggttgacggcgctgcaggcatttgtgatgctaaacatgctggtgctgttcggcaacttctacatgaagtcgtactccaaggccagcaagctggagccggcctcccccgtgtcccccgcctccctcgcccagaaaccgttcgagaacgccaaggtgaag

SEQ ID NO: 228 - DNA, 897 bp, Euglena anabaena
atggccgaaggcaagagcgatgggcctgtggtgacccttcaaagcatgtggaaaccgcttgctctgatggcaatagatgtcggcatattggtcaatgtccgccgcaaggctttcactgagtttgatgggcacagcaacgttttcgcagatccagtttacattccatttgtgatgaatctcttctacttgaccatgatctttgctgggtgccgttggatgaagactcgcgaaccctttgagatcaagtcatatatgtttgcatacaatgcatatcagacaatgatgaacttcctcattgtcgtcgggttcatgtatgaggtgcacagcacagggatgcgatattgggggtccaggatcgacacctccaccaagggcttgggcctcggtttcctgatctatgcccactaccacaacaaatacgtggagtatgtcgacacgttgttcatgatcctgcgcaagaaaaacaaccagatctcgttcctccacgtctaccaccattcgcttttgacttgggcctggtgggccgtggtctactgggccccaggaggagatgcctggttcggagcatgctacaattccttcatccacgtgctgatgtactcctactacctgtttgcaacgtttggcatcaggtgcccctggaagaagatgctgacccagttgcagatggtgcaattctgcttctgctttgcccacgcgatgtatgttggatggctgggccatgaagtctacccgcgctggttgacggcgctacaggcatttgtgatgctaaacatgctggtgctgttcggcaacttctacatgaagtcgtactccaaggccagcaagctggagccggcctcccccgtgtcccccgcctccctcgcccagaagccgttcgagaacgccaaggtgaag

SEQ ID NO: 229 - DNA, 897 bp, Euglena anabaena
atggccgaaggcaagagcgatgggcctgtggtgacccttcaaagcatgtggaaaccgcttgctttgatggcagtagatgtcggcatattggtcaatgtccgccgcaaggctttcactgagtttgatgggcacagcaacgtttttgcagatccagtttacattccatttgtgatgaatctcttctacttgaccatgatctttgctgggtgccgttggatgaagactcgcgagccctttgagatcaagtcatatatgtttgcatacaatgcatatcagacaatgatgaacttcctcattgtcgtcgggttcatgtatgaggtgcacagcacagggatgcgatattgggggtccaggatcgacacctccaccaagggcttgggcctcggtttcctgatctatgcccactaccacaacaaatatgtggagtatgtcgacacgttgttcatgatcctgcgcaagaaaaacaaccagatctcgttcctccacgtctaccaccattcgcttttgacttgggcctggtgggccgtggtctactgggccccgggaggagatgcctggttcggagcatgctacaattccttcatccacgtgctgatgtactcctactacctgtttgcaacgtttggcatcaggtgcccctggaagaagatgctgacccagttgcagatggtgcaattctgcttctgctttgcccacgcgatgtatgttggatggctgggccatgaagtctacccgcgctggttgacggcgctgcaggcatttgtgatgctaaacatgctggtgctgttcggcaacttctacatgaagtcgtactccaaggccagcaagctggagccggcctcccccgcgtcccccgcctccctcgcccagaaaccgttcgagaacgccaaggtgaag

SEQ ID NO: 230 - DNA, 897 bp, Euglena anabaena
atggccgaaggcaagagcgatgggcctgtggtgacccttcaaagcatgtggaaaccgcttgctttgatggcagtagatgtcggcatattggtcaacgtccgccgcaaggctttcactgagtttgatgggcacagcaacgtttttgcagatcccgtttacattccatttgtgatgaatctcttctacttgaccatgatctttgctgggtgccgttggatgaagactcgcgaaccctttgagatcaagtcatatatgtttgcatacaatgcatatcagacgatgatgaacttcctcattgtcgtcgggttcatgtatgaggtgcacagcacagggatgcggtattgggggtccaggatcgacacctccaccaagggcttgggcctcggtttcctgatctatgcccactaccacaacaaatacgtggagtatgtcgacacgttgttcatgatcctgcgcaagaaaaacaaccagatctcgttcctccacgtctaccaccattcgcttttgacttgggcctggtgggccgtggtctactgggccccaggaggagatgcctggttcggagcatgctacaattcctttatccacgtgctgatgtactcctactacctgtttgcaacgtttggcatcaggtgcccctggaagaagatgctgacccagttgcagatggtgcaattctgcttctgctttgcccacgcgatgtatgttggatggctgggccatgaagtctacccgcgctggttgacggcgctacaggcatttgtgatgctaaacatgctggtgctgttcggcaacttctacatgaagtcgtactccaaggccagcaagctggagccggcctcccccgtgtcccccgcctccctcgcccagaagccgttcgagaacgccaaggtgaag

SEQ ID NO: 231 - protein, 299 aa, Euglena anabaena
MAEGKSDGPVVTLQSMWKPLALMAVDVGILVNVRRKAFTEFDGHSNVFADPVYIPFVMNLFYLTMIFAGCRWMKTREPFEIKSYMFAYNAYQTMMNFLIVVGFMYEVHSTGMRYWGSRIDTSTKGLGLGFLIYAHYHNKYVEYVDTLFMILRKKNNQISFLHVYHHSLLTWAWWAVVYWAPGGDAWFGACYNSFIHVLMYSYYLFATFGIRCPWKKMLTQLQMVQFCFCFAHAMYVGWLGHEVYPRWLTALQAFVMLNMLVLFGNFYMKSYSKASKLEPASPVSPASLAQKPFENAKVK

SEQ ID NO: 232 - protein, 299 aa, Euglena anabaena; identical to SEQ ID NO: 189

SEQ ID NO: 233 - protein, 299 aa, Euglena anabaena
MAEGKSDGPVVTLQSMWKPLALMAVDVGILVNVRRKAFTEFDGHSNVFADPVYIPFVMNLFYLTMIFAGCRWMKTREPFEIKSYMFAYNAYQTMMNFLIVVGFMYEVHSTGMRYWGSRIDTSTKGLGLGFLIYAHYHNKYVEYVDTLFMILRKKNNQISFLHVYHHSLLTWAWWAVVYWAPGGDAWFGACYNSFIHVLMYSYYLFATFGIRCPWKKMLTQLQMVQFCFCFAHAMYVGWLGHEVYPRWLTALQAFVMLNMLVLFGNFYMKSYSKASKLEPASPASPASLAQKPFENAKVK

SEQ ID NO: 234 - DNA, 99 bp, Euglena anabaena
cctgggggccccggcaagccaagcgagattgcgtcgctgccaccgccaattcgaccagtcgggaacccacctgcagcctactacgatgccctggcgacc

SEQ ID NO: 235 - protein, 33 aa, Euglena anabaena
PGGPGKPSEIASLPPPIRPVGNPPAAYYDALAT

SEQ ID NO: 236 - DNA, 1527 bp, Euglena anabaena
tcgggcaccgggcaggaccgcaagttcaccatgcgggaggtggcccgccatattgtgccgaccgacgggtggttggcatgccatgacggtgtctacgacatcaccgagttcatagggaaacatcctggcggcgatgttatttctctcggattgggcagggactccacaatcctggttgagtcgtaccaccctgccggaaggccagacaaggtcatggaaaagtaccgcatcgggacgctccaggaccaccgcacgttctacgactggcaggcctccgcgttctacgccgagctgaagcagcgggtggtgcagacgctaaaggaggccggccaaccgcggcgtgggggcctgtcggtcaaagcggcgctggtcatggcagcgttcgcggcgtcgttctacctcatggtgacccagggatccttcttctgggccgccgtctggggcctcgccggctcccacattggcctcagcatccagcacgacgggaaccacggggctttcagtaagagtggtcggctgaaccgcctcgcaggctggggcatggacgttatcggggcctcctcgacggcctgggagtaccagcacgtcatcgggcaccaccagtacaccaacctggtatcggatcccgagttcgcgctgcctgagaacgacccggacgtcttcggcacctatccgctgatgcggatgcatccggacaccccttggaagccgcaccaccagctgcagcatatgtacgcgttcccgctgttcgccctgatgaccatcagcaaggtcatcatcagtgacttcacgttctgcctcgccaagcggcgcgggccgatcgacttctccgccaggctcgtgccacttgaggggcagatgctcttctggggcgcgaagatcatggggttcctgatgcagatagtcctgccgtgctatctgcatggcatcgcccatgggctggcgctgttcatcacagcccacctggtgtcgggagagtacctcgcggtctgcttcatcatcaaccacatctctgagtcatgcgactatttgaatccaagttccgtcatcgctgcgcggcggacggaaatgctgaagcaggcggagcaggaggccaaggcaaagcagaagcaccccaccccaccgcccaacgactgggccgcgtctcaggtactgtgctgcgtaaactggcgctctggtggatatttctcaaaccacctctcaggcgggctgaaccaccagatcgagcaccacctcttccccagcatctcacatgcgaactatccgaccattgccccagttgtgaaaggggtgtgcgaggagtacggcctcccctacaagaactactcccagttctctgacgctatctatggaatggtggagcacctcagggcgatgggcacgaagcccgaagacaacggcaagctggcgccactgccgggctccctggaggacgtgtgcccggtcctgagtgccgccgttgctgcccaacctgacggaagcaccgacggcagcgctgcgggttgtccagcagtagccacactggca

SEQ ID NO: 237 - DNA, 1527 bp, Euglena anabaena
tcgggcaccgggcaggaccgcaagttcaccatgcgggaggtggcccgccatattgtgccgaccgatgggtggttggcgtgccatgacggtgtctacgacatcaccgagttcatagggaaacatcctggcggcgatgttatttctctcggattgggcagggactccacaatcctggttgagtcgtaccaccctgccggaaggccagacaaggtcatggaaaagtaccgcatcgggacgctccaggaccaccgcacgttctacgactggcaggcctccgcgttctacgccgagctgaagcagcgggtggtgcagacgctaaaggaggccggccaaccgcggcgtgggggcctgtcggtcaaagcggcgctggtcatggcggcgttcgcagcgtcgttctacctcatggtgacccagggatccttcttctgggccgccgtctggggcctcgccggctcccacattggcctcagcatccagcacgacgggaaccacggggctttcagtaagagtggtcggctgaaccgcctcgcgggctggggcatggacgtcatcggggcctcctcgacggcctgggagtaccagcacgtcatcgggcaccaccagtacaccaacctggtatcggatcccgagttcgcgctgcctgagaacgacccggacgtcttcggcacctatccgctgatgcggatgcatccggacaccccttggaagccgcaccaccagctgcagcatgtgtacgcgttcccgctgttcgccctgatgaccatcagcaaggtcatcatcagcgacttcacgttctgcctcgccaagcggcgcgggccgatcgacttctccgccaggctcgtgccacttgaggggcagatgctcttctggggggcgaagatcatggggttcctgatgcagatagtcctgccgtgctatctgcatggcatcgcccatgggctggcgctgttcatcacagcccacctggtgtcgggagagtacctcgcggtctgcttcatcatcaaccacatctctgagtcatgcgactatttgaatccaagttccgtcatcgctgcgcggaggacggaaatgctgaagcaggcggagcaggaggccaaggcaaagcagaagcaccccaccccaccgcccaacgactgggccgcgtctcaggtactgtgctgcgtaaactggcgctctggtggctatttctcaaaccacctctcaggcgggctgaaccaccagatcgagcaccacctcttccccagcatctcacatgcgaactatccgaccattgccccagttgtgaaaggggtgtgcgaggagtacggcctcccctacaagaactactcccagttctccgacgctctctatggaatggtggagcacctcagggcgatgggcacgaagccggcagacaacgacaagctggcgcccaccgcgggctccctggaggacgtgtgcccggtcttgagcgccgccgttgctgcccaacctgacggaagcaccgacggcagcgctgcgggttgtccagcagtagccacactggca

SEQ ID NO: 238 - DNA, 1446 bp, Euglena anabaena
tcgggcaccgggcaggaccgcaagttcaccatgcgggaggtggcccgccatattgtgccgaccgatgggtggttggcgtgccatgacggtgtctacgacatcaccgagttcatagggaaacatcctggcggcgatgttatttctctcggattgggcagggactccacaatcctggttgagtcgtaccaccctgccggaaggccagacaaggtcatggaaaagtaccgcatcgggacgctccaggaccaccgcacgttctacgactggcaggcctccgcgttctacgccgagctgaagcagcgggtggtgcagacgctaaaggaggccggccaaccgcggcgtgggggcctgtcggtcaaagcggcgctggtcatggcggcgttcgcagcgtcgttctacctcatggtgacccagggatccttcttctgggccgccgtctggggcctcgccggctcccacattggcctcagcatccagcacgacgggaaccacggggctttcagtaagagtggtcggctgaaccgcctcgcgggctggggcatggacgtcatcggggcctcctcgacggcctgggagtaccagcacgtcatcgggcaccaccagtacaccaacctggtatcggatcccgagttcgcgctgcctgagaacgacccggacgtcttcggcacctatccgctgatgcggatgcatccggacaccccttggaagccgcaccaccagctgcagcatatgtacgcgttcccgctgttcgccctgatgaccatcagcaaggtcatcatcagcgacttcacgttctgcctcgccaagcggcgcgggccgatcgacttctccgccaggctcgtgccacttgaggggcagatgctcttctggggggcgaagatcatggggttcctgatgcagatagtcctgccgtgctatctgcatggcatcgcccatgggctggcgctgttcatcacagcccacctggtgtcgggagagtacctcgcggtctgcttcatcatcaaccacatctctgagtcatgcgactatttgaatccaagttccgtcatcgctgcgcggcggacggaaatgctgaagcaggcggagcaggaggccaaggcaaagcagaagcaccccaccccaccgcccaacgactgggccgcgtctcaggtactgtgctgcgtaaactggcgctctggtggatatttctcaaaccacctctcaggcgggctgaaccaccagatcgagcaccacctcttccccagcatctcacatgcgaactatccgaccattgccccagttgtgaaaagggtgtgcgaggagtacggcctcccctacaagaactactcccagttctctgacctctctatggaatggtggagcacctcagggcgatgggcacgaagccggcagacaacgacaagctggcgccaccactgggctccctggaggacgtgtgcccggtcc

SEQ ID NO: 239 - protein, 509 aa, Euglena anabaena
SGTGQDRKFTMREVARHIVPTDGWLACHDGVYDITEFIGKHPGGDVISLGLGRDSTILVESYHPAGRPDKVMEKYRIGTLQDHRTFYDWQASAFYAELKQRVVQTLKEAGQPRRGGLSVKAALVMAAFAASFYLMVTQGSFFWAAVWGLAGSHIGLSIQHDGNHGAFSKSGRLNRLAGWGMDVIGASSTAWEYQHVIGHHQYTNLVSDPEFALPENDPDVFGTYPLMRMHPDTPWKPHHQLQHMYAFPLFALMTISKVIISDFTFCLAKRRGPIDFSARLVPLEGQMLFWGAKIMGFLMQIVLPCYLHGIAHGLALFITAHLVSGEYLAVCFIINHISESCDYLNPSSVIAARRTEMLKQAEQEAKAKQKHPTPPPNDWAASQVLCCVNWRSGGYFSNHLSGGLNHQIEHHLFPSISHANYPTIAPVVKGVCEEYGLPYKNYSQFSDAIYGMVEHLRAMGTKPEDNGKLAPLPGSLEDVCPVLSAAVAAQPDGSTDGSAAGCPAVATLA

SEQ ID NO: 240 - protein, 509 aa, Euglena anabaena
SGTGQDRKFTMREVARHIVPTDGWLACHDGVYDITEFIGKHPGGDVISLGLGRDSTILVESYHPAGRPDKVMEKYRIGTLQDHRTFYDWQASAFYAELKQRVVQTLKEAGQPRRGGLSVKAALVMAAFAASFYLMVTQGSFFWAAVWGLAGSHIGLSIQHDGNHGAFSKSGRLNRLAGWGMDVIGASSTAWEYQHVIGHHQYTNLVSDPEFALPENDPDVFGTYPLMRMHPDTPWKPHHQLQHVYAFPLFALMTISKVIISDFTFCLAKRRGPIDFSARLVPLEGQMLFWGAKIMGFLMQIVLPCYLHGIAHGLALFITAHLVSGEYLAVCFIINHISESCDYLNPSSVIAARRTEMLKQAEQEAKAKQKHPTPPPNDWAASQVLCCVNWRSGGYFSNHLSGGLNHQIEHHLFPSISHANYPTIAPVVKGVCEEYGLPYKNYSQFSDALYGMVEHLRAMGTKPADNDKLAPTAGSLEDVCPVLSAAVAAQPDGSTDGSAAGCPAVATLA

SEQ ID NO: 241 - protein, 482 aa, Euglena anabaena
SGTGQDRKFTMREVARHIVPTDGWLACHDGVYDITEFIGKHPGGDVISLGLGRDSTILVESYHPAGRPDKVMEKYRIGTLQDHRTFYDWQASAFYAELKQRVVQTLKEAGQPRRGGLSVKAALVMAAFAASFYLMVTQGSFFWAAVWGLAGSHIGLSIQHDGNHGAFSKSGRLNRLAGWGMDVIGASSTAWEYQHVIGHHQYTNLVSDPEFALPENDPDVFGTYPLMRMHPDTPWKPHHQLQHMYAFPLFALMTISKVIISDFTFCLAKRRGPIDFSARLVPLEGQMLFWGAKIMGFLMQIVLPCYLHGIAHGLALFITAHLVSGEYLAVCFIINHISESCDYLNPSSVIAARRTEMLKQAEQEAKAKQKHPTPPPNDWAASQVLCCVNWRSGGYFSNHLSGGLNHQIEHHLFPSISHANYPTIAPVVKRVCEEYGLPYKNYSQFSDLSMEWWSTSGRWARSRQTTTSWRHHWAPWRTCARS

SEQ ID NO: 242 - DNA, 1749 bp, Euglena anabaena
atgctggtgctgttcggcaacttctacatgaagtcgtactccaaggccagcaagctggagccggcctcccccgtgtcccccgcctccctcgcccagaaaccgttcgagaacgccaaggtgaagcctgggggccccggcaagccaagcgagattgcgtcgctgccaccgccaattcgaccagtcgggaacccacctgcagcctactacgatgccctggcgacctcgggcaccgggcaggaccgcaagttcaccatgcgggaggtggcccgccatattgtgccgaccgacgggtggttggcatgccatgacggtgtctacgacatcaccgagttcatagggaaacatcctggcggcgatgttatttctctcggattgggcagggactccacaatcctggttgagtcgtaccaccctgccggaaggccagacaaggtcatggaaaagtaccgcatcgggacgctccaggaccaccgcacgttctacgactggcaggcctccgcgttctacgccgagctgaagcagcgggtggtgcagacgctaaaggaggccggccaaccgcggcgtgggggcctgtcggtcaaagcggcgctggtcatggcagcgttcgcggcgtcgttctacctcatggtgacccagggatccttcttctgggccgccgtctggggcctcgccggctcccacattggcctcagcatccagcacgacgggaaccacggggctttcagtaagagtggtcggctgaaccgcctcgcaggctggggcatggacgttatcggggcctcctcgacggcctgggagtaccagcacgtcatcgggcaccaccagtacaccaacctggtatcggatcccgagttcgcgctgcctgagaacgacccggacgtcttcggcacctatccgctgatgcggatgcatccggacaccccttggaagccgcaccaccagctgcagcatatgtacgcgttcccgctgttcgccctgatgaccatcagcaaggtcatcatcagtgacttcacgttctgcctcgccaagcggcgcgggccgatcgacttctccgccaggctcgtgccacttgaggggcagatgctcttctggggcgcgaagatcatggggttcctgatgcagatagtcctgccgtgctatctgcatggcatcgcccatgggctggcgctgttcatcacagcccacctggtgtcgggagagtacctcgcggtctgcttcatcatcaaccacatctctgagtcatgcgactatttgaatccaagttccgtcatcgctgcgcggcggacggaaatgctgaagcaggcggagcaggaggccaaggcaaagcagaagcaccccaccccaccgcccaacgactgggccgcgtctcaggtactgtgctgcgtaaactggcgctctggtggatatttctcaaaccacctctcaggcgggctgaaccaccagatcgagcaccacctcttccccagcatctcacatgcgaactatccgaccattgccccagttgtgaaaggggtgtgcgaggagtacggcctcccctacaagaactactcccagttctctgacgctatctatggaatggtggagcacctcagggcgatgggcacgaagcccgaagacaacggcaagctggcgccactgccgggctccctggaggacgtgtgcccggtcctgagtgccgccgttgctgcccaacctgacggaagcaccgacggcagcgctgcgggttgtccagcagtagccacactggca

SEQ ID NO: 243 - DNA, 1749 bp, Euglena anabaena; identical to SEQ ID NO: 194

SEQ ID NO: 244 - DNA, 1749 bp, Euglena anabaena
atgctggtgctgttcggcaacttctacatgaagtcgtactccaaggccagcaagctggagccggcctcccccgcgtcccccgcctccctcgcccagaaaccgttcgagaacgccaaggtgaagcctgggggccccggcaagccaagcgagattgcgtcgctgccaccgccaattcgaccagtcgggaacccacctgcagcctactacgatgccctggcgacctcgggcaccgggcaggaccgcaagttcaccatgcgggaggtggcccgccatattgtgccgaccgacgggtggttggcatgccatgacggtgtctacgacatcaccgagttcatagggaaacatcctggcggcgatgttatttctctcggattgggcagggactccacaatcctggttgagtcgtaccaccctgccggaaggccagacaaggtcatggaaaagtaccgcatcgggacgctccaggaccaccgcacgttctacgactggcaggcctccgcgttctacgccgagctgaagcagcgggtggtgcagacgctaaaggaggccggccaaccgcggcgtgggggcctgtcggtcaaagcggcgctggtcatggcagcgttcgcggcgtcgttctacctcatggtgacccagggatccttcttctgggccgccgtctggggcctcgccggctcccacattggcctcagcatccagcacgacgggaaccacggggctttcagtaagagtggtcggctgaaccgcctcgcaggctggggcatggacgttatcggggcctcctcgacggcctgggagtaccagcacgtcatcgggcaccaccagtacaccaacctggtatcggatcccgagttcgcgctgcctgagaacgacccggacgtcttcggcacctatccgctgatgcggatgcatccggacaccccttggaagccgcaccaccagctgcagcatatgtacgcgttcccgctgttcgccctgatgaccatcagcaaggtcatcatcagtgacttcacgttctgcctcgccaagcggcgcgggccgatcgacttctccgccaggctcgtgccacttgaggggcagatgctcttctggggcgcgaagatcatggggttcctgatgcagatagtcctgccgtgctatctgcatggcatcgcccatgggctggcgctgttcatcacagcccacctggtgtcgggagagtacctcgcggtctgcttcatcatcaaccacatctctgagtcatgcgactatttgaatccaagttccgtcatcgctgcgcggcggacggaaatgctgaagcaggcggagcaggaggccaaggcaaagcagaagcaccccaccccaccgcccaacgactgggccgcgtctcaggtactgtgctgcgtaaactggcgctctggtggatatttctcaaaccacctctcaggcgggctgaaccaccagatcgagcaccacctcttccccagcatctcacatgcgaactatccgaccattgccccagttgtgaaaggggtgtgcgaggagtacggcctcccctacaagaactactcccagttctctgacgctatctatggaatggtggagcacctcagggcgatgggcacgaagcccgaagacaacggcaagctggcgccactgccgggctccctggaggacgtgtgcccggtcctgagtgccgccgttgctgcccaacctgacggaagcaccgacggcagcgctgcgggttgtccagcagtagccacactggca

SEQ ID NO: 245 - DNA, 1668 bp, Euglena anabaena
atgctggtgctgttcggcaacttctacatgaagtcgtactccaaggccagcaagctggagccggcctcccccgtgtcccccgcctccctcgcccagaagccgttcgagaacgccaaggtgaagcctgggggccccggcaagccaagcgagattgcgtcgctgccaccgccaattcgaccagtcgggaacccacctgcagcctactacgatgccctggcgacctcgggcaccgggcaggaccgcaagttcaccatgcgggaggtggcccgccatattgtgccgaccgatgggtggttggcgtgccatgacggtgtctacgacatcaccgagttcatagggaaacatcctggcggcgatgttatttctctcggattgggcagggactccacaatcctggttgagtcgtaccaccctgccggaaggccagacaaggtcatggaaaagtaccgcatcgggacgctccaggaccaccgcacgttctacgactggcaggcctccgcgttctacgccgagctgaagcagcgggtggtgcagacgctaaaggaggccggccaaccgcggcgtgggggcctgtcggtcaaagcggcgctggtcatggcggcgttcgcagcgtcgttctacctcatggtgacccagggatccttcttctgggccgccgtctggggcctcgccggctcccacattggcctcagcatccagcacgacgggaaccacggggctttcagtaagagtggtcggctgaaccgcctcgcgggctggggcatggacgtcatcggggcctcctcgacggcctgggagtaccagcacgtcatcgggcaccaccagtacaccaacctggtatcggatcccgagttcgcgctgcctgagaacgacccggacgtcttcggcacctatccgctgatgcggatgcatccggacaccccttggaagccgcaccaccagctgcagcatatgtacgcgttcccgctgttcgccctgatgaccatcagcaaggtcatcatcagcgacttcacgttctgcctcgccaagcggcgcgggccgatcgacttctccgccaggctcgtgccacttgaggggcagatgctcttctggggggcgaagatcatggggttcctgatgcagatagtcctgccgtgctatctgcatggcatcgcccatgggctggcgctgttcatcacagcccacctggtgtcgggagagtacctcgcggtctgcttcatcatcaaccacatctctgagtcatgcgactatttgaatccaagttccgtcatcgctgcgcggcggacggaaatgctgaagcaggcggagcaggaggccaaggcaaagcagaagcaccccaccccaccgcccaacgactgggccgcgtctcaggtactgtgctgcgtaaactggcgctctggtggatatttctcaaaccacctctcaggcgggctgaaccaccagatcgagcaccacctcttccccagcatctcacatgcgaactatccgaccattgccccagttgtgaaaagggtgtgcgaggagtacggcctcccctacaagaactactcccagttctctgacctctctatggaatggtggagcacctcagggcgatgggcacgaagccggcagacaacgacaagctggcgccaccactgggctccctggaggacgtgtgcccggtcc

SEQ ID NO: 246 - protein, 583 aa, Euglena anabaena
MLVLFGNFYMKSYSKASKLEPASPVSPASLAQKPFENAKVKPGGPGKPSEIASLPPPIRPVGNPPAAYYDALATSGTGQDRKFTMREVARHIVPTDGWLACHDGVYDITEFIGKHPGGDVISLGLGRDSTILVESYHPAGRPDKVMEKYRIGTLQDHRTFYDWQASAFYAELKQRVVQTLKEAGQPRRGGLSVKAALVMAAFAASFYLMVTQGSFFWAAVWGLAGSHIGLSIQHDGNHGAFSKSGRLNRLAGWGMDVIGASSTAWEYQHVIGHHQYTNLVSDPEFALPENDPDVFGTYPLMRMHPDTPWKPHHQLQHMYAFPLFALMTISKVIISDFTFCLAKRRGPIDFSARLVPLEGQMLFWGAKIMGFLMQIVLPCYLHGIAHGLALFITAHLVSGEYLAVCFIINHISESCDYLNPSSVIAARRTEMLKQAEQEAKAKQKHPTPPPNDWAASQVLCCVNWRSGGYFSNHLSGGLNHQIEHHLFPSISHANYPTIAPVVKGVCEEYGLPYKNYSQFSDAIYGMVEHLRAMGTKPEDNGKLAPLPGSLEDVCPVLSAAVAAQPDGSTDGSAAGCPAVATLA

SEQ ID NO: 247 - protein, 583 aa, Euglena anabaena; identical to SEQ ID NO: 195

SEQ ID NO: 248 - protein, 583 aa, Euglena anabaena
MLVLFGNFYMKSYSKASKLEPASPASPASLAQKPFENAKVKPGGPGKPSEIASLPPPIRPVGNPPAAYYDALATSGTGQDRKFTMREVARHIVPTDGWLACHDGVYDITEFIGKHPGGDVISLGLGRDSTILVESYHPAGRPDKVMEKYRIGTLQDHRTFYDWQASAFYAELKQRVVQTLKEAGQPRRGGLSVKAALVMAAFAASFYLMVTQGSFFWAAVWGLAGSHIGLSIQHDGNHGAFSKSGRLNRLAGWGMDVIGASSTAWEYQHVIGHHQYTNLVSDPEFALPENDPDVFGTYPLMRMHPDTPWKPHHQLQHMYAFPLFALMTISKVIISDFTFCLAKRRGPIDFSARLVPLEGQMLFWGAKIMGFLMQIVLPCYLHGIAHGLALFITAHLVSGEYLAVCFIINHISESCDYLNPSSVIAARRTEMLKQAEQEAKAKQKHPTPPPNDWAASQVLCCVNWRSGGYFSNHLSGGLNHQIEHHLFPSISHANYPTIAPVVKGVCEEYGLPYKNYSQFSDAIYGMVEHLRAMGTKPEDNGKLAPLPGSLEDVCPVLSAAVAAQPDGSTDGSAAGCPAVATLA

SEQ ID NO: 249 - protein, 556 aa, Euglena anabaena
MLVLFGNFYMKSYSKASKLEPASPVSPASLAQKPFENAKVKPGGPGKPSEIASLPPPIRPVGNPPAAYYDALATSGTGQDRKFTMREVARHIVPTDGWLACHDGVYDITEFIGKHPGGDVISLGLGRDSTILVESYHPAGRPDKVMEKYRIGTLQDHRTFYDWQASAFYAELKQRVVQTLKEAGQPRRGGLSVKAALVMAAFAASFYLMVTQGSFFWAAVWGLAGSHIGLSIQHDGNHGAFSKSGRLNRLAGWGMDVIGASSTAWEYQHVIGHHQYTNLVSDPEFALPENDPDVFGTYPLMRMHPDTPWKPHHQLQHMYAFPLFALMTISKVIISDFTFCLAKRRGPIDFSARLVPLEGQMLFWGAKIMGFLMQIVLPCYLHGIAHGLALFITAHLVSGEYLAVCFIINHISESCDYLNPSSVIAARRTEMLKQAEQEAKAKQKHPTPPPNDWAASQVLCCVNWRSGGYFSNHLSGGLNHQIEHHLFPSISHANYPTIAPVVKRVCEEYGLPYKNYSQFSDLSMEWWSTSGRWARSRQTTTSWRHHWAPWRTCARS

SEQ ID NO: 250 - DNA, 3668 bp, Artificial Sequence
  Plasmid pLF121-1
  misc_feature (3616)..(3655): n is a, c, g, or t
gtacaaagttggcattataagaaagcattgcttatcaatttgttgcaacgaacaggtcactatcagtcaaaataaaatcattatttgccatccagctgatatcccctatagtgagtcgtattacatggtcatagctgtttcctggcagctctggcccgtgtctcaaaatctctgatgttacattgcacaagataaaaatatatcatcatgttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcatagatcttttctccatcactgatagggagtggtaaaataactccatcaatgatagagtgtcaacaacatgaccaaaatcccttaacgtgagttacgcgtattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggttacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagggaacgacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttaacgctagcatggatgttttcccagtcacgacgttgtaaaacgacggccagtcttaagctcgggccccaaataatgattttattttgactgatagtgacctgttcgttgcaacaaattgatgagcaatgcttttttataatgccaactttgtacaaaaaagttggtttttttcggtctaaaatggaagcagccaaagaattggtttccatcgtccaagaggagctccccaaggtggactatgcccagctttggcaggatgccagcagctgtgaggtcctttacctctcggtggcattcgtggcgatcaagttcatgctgcgcccactggacctgaagcgccaggccaccttgaagaagctgttcacagcatacaacttcctcatgtcgatctattcctttggctccttcctggccatggcctatgccctatcagtaactggcatcctctccggcgactgtgagacggcgttcaacaacgatgtgttcaggatcacaactcagctgttctacctcagcaagttcgtagagtacatcgactccttctaccttccccttatggacaagccactgtcgttccttcagttcttccatcatttgggggcccccattgacatgtggctattctacaaataccgcaacgaaggagtctggatctttgtcctgttgaatgggttcattcactggatcatgtacggttactattggacgcggctcatcaagctgaacttccccatgcccaagaacctgatcacctccatgcagatcatccagttcaatgtcgggttctacatcgtctggaagtaccgcaatgtgccatgctaccgccaggatgggatgcgcatgtttgcctggatcttcaactactggtatgtcgggacggtcttgctgctgttcctcaacttttacgtgcagacgtacatccggaagccgaggaagaaccgagggaagaaggagtaggccacatggcgcctgcgctggaggaaacggtacgctcggatggtgcactgcacttgcactccgccgtttctagcctcccctcgctctaaccactgcggcatgcctgcttgaggcgtgacgttgcctcgtatgatacagtttacacccttcccacagcccacggagctggtgactgtttccagcgtctgcagatcattgatctggtgcaatgtgcacagaccaagcccctctaacgtcttgcggtgtaccgctcgacactcactgcaagagacagatggctgagcatgttatagccccttacattctacccttcgtcccaacctgaccgtcacattcnnnnnnnnnnnnnnnnnnnnnnnnnnnnnnnnnnnnnnnnacccaactttctt

SEQ ID NO: 251 - DNA, 3684 bp, Artificial Sequence
  Plasmid pLF121-2
  misc_feature (3632)..(3671): n is a, c, g, or t
gtacaaagttggcattataagaaagcattgcttatcaatttgttgcaacgaacaggtcactatcagtcaaaataaaatcattatttgccatccagctgatatcccctatagtgagtcgtattacatggtcatagctgtttcctggcagctctggcccgtgtctcaaaatctctgatgttacattgcacaagataaaaatatatcatcatgttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcatagatcttttctccatcactgatagggagtggtaaaataactccatcaatgatagagtgtcaacaacatgaccaaaatcccttaacgtgagttacgcgtattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggttacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagggaacgacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttaacgctagcatggatgttttcccagtcacgacgttgtaaaacgacggccagtcttaagctcgggccccaaataatgattttattttgactgatagtgacctgttcgttgcaacaaattgatgagcaatgcttttttataatgccaactttgtacaaaaaagttggattttttttcggtctaaaatggaagcagccaaagaattggtttccatcgtccaagaggagctccccaaggtggactatgcccagctttggcaggacgccagcagctgtgaggtcctttacctctcggtggcattcgtggcgatcaagttcatgctgcgcccactggacctgaagcgccaggccaccttgaagaagctgttcacagcatacaacttcctcatgtcgatctattcctttggctccttcctggccatggcctatgccctatcagtaactggcatcctctccggcgactgtgagacagcgttcaacaacgatgtgttcaggatcacaactcagctgttctacctcagcaagttcgtagagtacatcgactccttctaccttccccttatggacaagccactgtcgttccttcagttcttccatcatttgggggctcccattgacatgtggctattctacaaataccgcaacgaaggagtctggatctttgtcctgttgaatgggttcattcactggatcatgtacggttactactggacgcggctcatcaagctgaacttccccatgcccaagaacctgatcacctccatgcagatcatccagttcaatgtcgggttctacatcgtctggaagtaccgcaatgtgccatgctaccgccaggatgggatgcgcatgtttgcctggatcttcaactactggtacgtcgggacggtcttgctgctgttcctcaacttttacgtgcagacgtacatccggaagccgaggaagaaccaagggaagaaggagtaggccacatggcgcctgcgctggaggaaacggtacgctcggatggtgcactgcacttgcactccgccgcttctagcctcccctcgctctaacctctgcgacatgcctgcttgaggcgtgacgttgcctcgtgcgatacagtttacacccttcccatggcccacggagcaggtgactgtctccagcgtctgcaattctgatcattggtctggtgcaatgtgcgcagaccaagcccctctaacgtcttgcggtgtaccgctcgacactcactgcacgagacagatggctgagcatgttatagcccctgacattctacccttcgtccttacctgaccgtcacattcatgcttaccnnnnnnnnnnnnnnnnnnnnnnnnnnnnnnnnnnnnnnnnacccaactttctt

SEQ ID NO: 252 - DNA, 774 bp, Euglena anabaena
atggaagcagccaaagaattggtttccatcgtccaagaggagctccccaaggtggactatgcccagctttggcaggatgccagcagctgtgaggtcctttacctctcggtggcattcgtggcgatcaagttcatgctgcgcccactggacctgaagcgccaggccaccttgaagaagctgttcacagcatacaacttcctcatgtcgatctattcctttggctccttcctggccatggcctatgccctatcagtaactggcatcctctccggcgactgtgagacggcgttcaacaacgatgtgttcaggatcacaactcagctgttctacctcagcaagttcgtagagtacatcgactccttctaccttccccttatggacaagccactgtcgttccttcagttcttccatcatttgggggcccccattgacatgtggctattctacaaataccgcaacgaaggagtctggatctttgtcctgttgaatgggttcattcactggatcatgtacggttactattggacgcggctcatcaagctgaacttccccatgcccaagaacctgatcacctccatgcagatcatccagttcaatgtcgggttctacatcgtctggaagtaccgcaatgtgccatgctaccgccaggatgggatgcgcatgtttgcctggatcttcaactactggtatgtcgggacggtcttgctgctgttcctcaacttttacgtgcagacgtacatccggaagccgaggaagaaccgagggaagaaggag

SEQ ID NO: 253 - DNA, 774 bp, Euglena anabaena
atggaagcagccaaagaattggtttccatcgtccaagaggagctccccaaggtggactatgcccagctttggcaggacgccagcagctgtgaggtcctttacctctcggtggcattcgtggcgatcaagttcatgctgcgcccactggacctgaagcgccaggccaccttgaagaagctgttcacagcatacaacttcctcatgtcgatctattcctttggctccttcctggccatggcctatgccctatcagtaactggcatcctctccggcgactgtgagacagcgttcaacaacgatgtgttcaggatcacaactcagctgttctacctcagcaagttcgtagagtacatcgactccttctaccttccccttatggacaagccactgtcgttccttcagttcttccatcatttgggggctcccattgacatgtggctattctacaaataccgcaacgaaggagtctggatctttgtcctgttgaatgggttcattcactggatcatgtacggttactactggacgcggctcatcaagctgaacttccccatgcccaagaacctgatcacctccatgcagatcatccagttcaatgtcgggttctacatcgtctggaagtaccgcaatgtgccatgctaccgccaggatgggatgcgcatgtttgcctggatcttcaactactggtacgtcgggacggtcttgctgctgttcctcaacttttacgtgcagacgtacatccggaagccgaggaagaaccaagggaagaaggag

SEQ ID NO: 254 - protein, 258 aa, Euglena anabaena
MEAAKELVSIVQEELPKVDYAQLWQDASSCEVLYLSVAFVAIKFMLRPLDLKRQATLKKLFTAYNFLMSIYSFGSFLAMAYALSVTGILSGDCETAFNNDVFRITTQLFYLSKFVEYIDSFYLPLMDKPLSFLQFFHHLGAPIDMWLFYKYRNEGVWIFVLLNGFIHWIMYGYYWTRLIKLNFPMPKNLITSMQIIQFNVGFYIVWKYRNVPCYRQDGMRMFAWIFNYWYVGTVLLLFLNFYVQTYIRKPRKNRGKKE

SEQ ID NO: 255 - protein, 258 aa, Euglena anabaena
MEAAKELVSIVQEELPKVDYAQLWQDASSCEVLYLSVAFVAIKFMLRPLDLKRQATLKKLFTAYNFLMSIYSFGSFLAMAYALSVTGILSGDCETAFNNDVFRITTQLFYLSKFVEYIDSFYLPLMDKPLSFLQFFHHLGAPIDMWLFYKYRNEGVWIFVLLNGFIHWIMYGYYWTRLIKLNFPMPKNLITSMQIIQFNVGFYIVWKYRNVPCYRQDGMRMFAWIFNYWYVGTVLLLFLNFYVQTYIRKPRKNQGKKE

SEQ ID NO: 256 - DNA, 4276 bp, Artificial Sequence
  Plasmid pLF119
gtacaaagttggcattataagaaagcattgcttatcaatttgttgcaacgaacaggtcactatcagtcaaaataaaatcattatttgccatccagctgatatcccctatagtgagtcgtattacatggtcatagctgtttcctggcagctctggcccgtgtctcaaaatctctgatgttacattgcacaagataaaaatatatcatcatgttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcatagatcttttctccatcactgatagggagtggtaaaataactccatcaatgatagagtgtcaacaacatgaccaaaatcccttaacgtgagttacgcgtattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggttacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagggaacgacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttaacgctagcatggatgttttcccagtcacgacgttgtaaaacgacggccagtcttaagctcgggccccaaataatgattttattttgactgatagtgacctgttcgttgcaacaaattgatgagcaatgcttttttataatgccaactttgtacaaaaaagttggattttttttcgggatggccaccatctctttgactactgagcaacttttagaacacccagaactggttgcaattgatggggtgttgtacgatctcttcggactggcgaaagtgcatccaggtggcaacctcattgaagccgccggtgcctccgacggaaccgccctgttctactccatgcaccctggagtgaagccagagaattcgaagctgctgcagcaatttgcccgaggcaaacacgaacgaagctcgaaggacccagtgtacacctttgacagtcccttcgcccaggatgtcaagcagagcgttcgggaggtcatgaaggggcgcaactggtacgccacgcccggcttttggctgcggaccgcgctgatcatcgcgtgcactgccataggcgaatggtattggatcactaccggggcagtgatgtggggcatcttcaccgggtacttccacagccagattgggttggcgattcaacacgatgcctctcacggagccatcagcaaaaagccctgggtgaacgcctttttcgcctacggcatcgacgccattggatcctcccgctggatctggctgcagtcccacattatgcgccaccacacctacaccaaccagcatggcctggacctggacgctgcctcggcggagccgttcattttgttccactcctacccggcaacaaatgcgtcacgaaagtggtaccatcggttccaggcgtggtacatgtacatcgttttggggatgtatggtgtgtcgatggtgtacaatccgatgtacttgttcacgatgcagcacaacgacacaatcccagaggccacctctcttagaccaggcagctttttcaaccggcagcgcgccttcgccgtttccctccgcctactgttcatcttccgcaacgccttcctcccctggtacatcgcgggcgcctctccgctgctcaccatcctgctggtgccaacggtcacaggcatcttcttgacatttgtttttgtgctgtcccataactttgaaggcgctgagcggacccccgaaaagaactgcaaggccaaaagggccaaggaggggaaggaggtccgcgatgtagaggaggaccgggtggactggtaccgggcgcaggccgagaccgcggcgacctacgggggcagcgtcgggatgatgctgaccggcggtttgaacctgcagatcgagcaccacttgttcccccgcatgtcctcttggcactaccccttcatccaagatacggtgcgggaatgttgcaagcgccatggcgtgcgctacacatactacccgaccatcctggagaatataatgtccacgctccgctacatgcagaaggtgggcgtggcccacacaattcaggatgcccaggaattctgagtgagttcgatccgcatcgacgtctaccatttttgatgctgtctattcctgttttcagtcacctccagcattctcatggctggtgaccactgcccctctaacccattgtgacacaccgccaaagactttgcctcttttttttccctttcttttgtcctcggggtgctttggccggtgtttactcgccttgcagtccccgcaaacgaccgacgtttaagctccgttgttgactgggccgctcgtaaacccatctgcaggttgaggctcccatggagaattgtgatggctgattaggaggtggcggggcatacatgcctcgacactcaaagccgggcggcttctggattcgaaaacgcaaatgggcgctttggaaaaaaaaaaaaaaaaaaaaaaaaaaaaacccaactttctt

SEQ ID NO: 257 - DNA, 1362 bp, Euglena anabaena
  misc_feature (1)..(1362): delta-5 desaturase; U.S. Provisional Application No. 60/915733 (filed May 3, 2007)
atggccaccatctctttgactactgagcaacttttagaacacccagaactggttgcaattgatggggtgttgtacgatctcttcggactggcgaaagtgcatccaggtggcaacctcattgaagccgccggtgcctccgacggaaccgccctgttctactccatgcaccctggagtgaagccagagaattcgaagctgctgcagcaatttgcccgaggcaaacacgaacgaagctcgaaggacccagtgtacacctttgacagtcccttcgcccaggatgtcaagcagagcgttcgggaggtcatgaaggggcgcaactggtacgccacgcccggcttttggctgcggaccgcgctgatcatcgcgtgcactgccataggcgaatggtattggatcactaccggggcagtgatgtggggcatcttcaccgggtacttccacagccagattgggttggcgattcaacacgatgcctctcacggagccatcagcaaaaagccctgggtgaacgcctttttcgcctacggcatcgacgccattggatcctcccgctggatctggctgcagtcccacattatgcgccaccacacctacaccaaccagcatggcctggacctggacgctgcctcggcggagccgttcattttgttccactcctacccggcaacaaatgcgtcacgaaagtggtaccatcggttccaggcgtggtacatgtacatcgttttggggatgtatggtgtgtcgatggtgtacaatccgatgtacttgttcacgatgcagcacaacgacacaatcccagaggccacctctcttagaccaggcagctttttcaaccggcagcgcgccttcgccgtttccctccgcctactgttcatcttccgcaacgccttcctcccctggtacatcgcgggcgcctctccgctgctcaccatcctgctggtgccaacggtcacaggcatcttcttgacatttgtttttgtgctgtcccataactttgaaggcgctgagcggacccccgaaaagaactgcaaggccaaaagggccaaggaggggaaggaggtccgcgatgtagaggaggaccgggtggactggtaccgggcgcaggccgagaccgcggcgacctacgggggcagcgtcgggatgatgctgaccggcggtttgaacctgcagatcgagcaccacttgttcccccgcatgtcctcttggcactaccccttcatccaagatacggtgcgggaatgttgcaagcgccatggcgtgcgctacacatactacccgaccatcctggagaatataatgtccacgctccgctacatgcagaaggtgggcgtggcccacacaattcaggatgcccaggaattc

SEQ ID NO: 258 - protein, 454 aa, Euglena anabaena
  MISC_FEATURE (1)..(454): delta-5 desaturase; U.S. Provisional Application No. 60/915733 (filed May 3, 2007)
MATISLTTEQLLEHPELVAIDGVLYDLFGLAKVHPGGNLIEAAGASDGTALFYSMHPGVKPENSKLLQQFARGKHERSSKDPVYTFDSPFAQDVKQSVREVMKGRNWYATPGFWLRTALIIACTAIGEWYWITTGAVMWGIFTGYFHSQIGLAIQHDASHGAISKKPWVNAFFAYGIDAIGSSRWIWLQSHIMRHHTYTNQHGLDLDAASAEPFILFHSYPATNASRKWYHRFQAWYMYIVLGMYGVSMVYNPMYLFTMQHNDTIPEATSLRPGSFFNRQRAFAVSLRLLFIFRNAFLPWYIAGASPLLTILLVPTVTGIFLTFVFVLSHNFEGAERTPEKNCKAKRAKEGKEVRDVEEDRVDWYRAQAETAATYGGSVGMMLTGGLNLQIEHHLFPRMSSWHYPFIQDTVRECCKRHGVRYTYYPTILENIMSTLRYMQKVGVAHTIQDAQEF

SEQ ID NO: 259 - DNA, 31 bp, Artificial Sequence
  EaD9-5Bbs primer
gaagacaccatggaagcagccaaagaattgg

SEQ ID NO: 260 - DNA, 30 bp, Artificial Sequence
  EaD9-3fusion primer
agctggacgggcgggctccttcttccctcg

SEQ ID NO: 261 - DNA, 30 bp, Artificial Sequence
  EgDHAsyn1Link-5fusion primer
cgagggaagaaggagcccgcccgtccagct

SEQ ID NO: 262 - DNA, 852 bp, Artificial Sequence
  EaD9elo1-EgDHAsyn1Link
gaagacaccatggaagcagccaaagaattggtttccatcgtccaagaggagctccccaaggtggactatgcccagctttggcaggatgccagcagctgtgaggtcctttacctctcggtggcattcgtggcgatcaagttcatgctgcgcccactggacctgaagcgccaggccaccttgaagaagctgttcacagcatacaacttcctcatgtcgatctattcctttggctccttcctggccatggcctatgccctatcagtaactggcatcctctccggcgactgtgagacggcgttcaacaacgatgtgttcaggatcacaactcagctgttctacctcagcaagttcgtagagtacatcgactccttctaccttccccttatggacaagccactgtcgttccttcagttcttccatcatttgggggcccccattgacatgtggctattctacaaataccgcaacgaaggagtctggatctttgtcctgttgaatgggttcattcactggatcatgtacggttactattggacgcggctcatcaagctgaacttccccatgcccaagaacctgatcacctccatgcagatcatccagttcaatgtcgggttctacatcgtctggaagtaccgcaatgtgccatgctaccgccaggatgggatgcgcatgtttgcctggatcttcaactactggtatgtcgggacggtcttgctgctgttcctcaacttttacgtgcagacgtacatccggaagccgaggaagaaccgagggaagaaggagcccgcccgtccagctggactcccgccggccacgtactacgactccctggcagtgagcggccgcgaattc

SEQ ID NO: 263 - DNA, 5559 bp, Artificial Sequence
  Plasmid pLF124
ggccgcaagtatgaactaaaatgcacgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaaggaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtaaagcaatggttgaccgtgtgcttagcttcttttattttatttttttatcagcaaagaataaataaaataaaatgagacacttcagggatgtttcaacggatcccccgggctgcaggaattcgatatcaagcttatcgataccgtcgacctcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccctagaactagtggatccttcatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactccatggaagcagccaaagaattggtttccatcgtccaagaggagctccccaaggtggactatgcccagctttggcaggatgccagcagctgtgaggtcctttacctctcggtggcattcgtggcgatcaagttcatgctgcgcccactggacctgaagcgccaggccaccttgaagaagctgttcacagcatacaacttcctcatgtcgatctattcctttggctccttcctggccatggcctatgccctatcagtaactggcatcctctccggcgactgtgagacggcgttcaacaacgatgtgttcaggatcacaactcagctgttctacctcagcaagttcgtagagtacatcgactccttctaccttccccttatggacaagccactgtcgttccttcagttcttccatcatttgggggcccccattgacatgtggctattctacaaataccgcaacgaaggagtctggatctttgtcctgttgaatgggttcattcactggatcatgtacggttactattggacgcggctcatcaagctgaacttccccatgcccaagaacctgatcacctccatgcagatcatccagttcaatgtcgggttctacatcgtctggaagtaccgcaatgtgccatgctaccgccaggatgggatgcgcatgtttgcctggatcttcaactactggtatgtcgggacggtcttgctgctgttcctcaacttttacgtgcagacgtacatccggaagccgaggaagaaccgagggaagaaggagcccgcccgtccagctggactcccgccggccacgtactacgactccctggcagtgagc

SEQ ID NO: 264 - DNA, 5559 bp, Artificial Sequence; identical to SEQ ID NO: 263
  Plasmid pKR1177

SEQ ID NO: 265 - DNA, 7916 bp, Artificial Sequence
  Plasmid pKR1179
gatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatcgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttggatctcctgcaggatctggccggccggatctcgtacggatccttcatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactccatggaagcagccaaagaattggtttccatcgtccaagaggagctccccaaggtggactatgcccagctttggcaggatgccagcagctgtgaggtcctttacctctcggtggcattcgtggcgatcaagttcatgctgcgcccactggacctgaagcgccaggccaccttgaagaagctgttcacagcatacaacttcctcatgtcgatctattcctttggctccttcctggccatggcctatgccctatcagtaactggcatcctctccggcgactgtgagacggcgttcaacaacgatgtgttcaggatcacaactcagctgttctacctcagcaagttcgtagagtacatcgactccttctaccttccccttatggacaagccactgtcgttccttcagttcttccatcatttgggggcccccattgacatgtggctattctacaaataccgcaacgaaggagtctggatctttgtcctgttgaatgggttcattcactggatcatgtacggttactattggacgcggctcatcaagctgaacttccccatgcccaagaacctgatcacctccatgcagatcatccagttcaatgtcgggttctacatcgtctggaagtaccgcaatgtgccatgctaccgccaggatgggatgcgcatgtttgcctggatcttcaactactggtatgtcgggacggtcttgctgctgttcctcaacttttacgtgcagacgtacatccggaagccgaggaagaaccgagggaagaaggagcccgcccgtccagctggactcccgccggccacgtactacgactccctggcagtgagcggccgcaagtatgaactaaaatgcacgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaaggaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtaaagcaatggttgaccgtgtgcttagcttcttttattttatttttttatcagcaaagaataaataaaataaaatgagacacttcagggatgtttcaacg

SEQ ID NO: 266 - DNA, 9190 bp, Artificial Sequence
  Plasmid pKR1183
ggccgcaagtatgaactaaaatgcacgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaaggaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtaaagcaatggttgaccgtgtgcttagcttcttttattttatttttttatcagcaaagaataaataaaataaaatgagacacttcagggatgtttcaacggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatcgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttggatctcctgcaggatctggccggccggatctcgtacggatccttcatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactccatggaagcagccaaagaattggtttccatcgtccaagaggagctccccaaggtggactatgcccagctttggcaggatgccagcagctgtgaggtcctttacctctcggtggcattcgtggcgatcaagttcatgctgcgcccactggacctgaagcgccaggccaccttgaagaagctgttcacagcatacaacttcctcatgtcgatctattcctttggctccttcctggccatggcctatgccctatcagtaactggcatcctctccggcgactgtgagacggcgttcaacaacgatgtgttcaggatcacaactcagctgttctacctcagcaagttcgtagagtacatcgactccttctaccttccccttatggacaagccactgtcgttccttcagttcttccatcatttgggggcccccattgacatgtggctattctacaaataccgcaacgaaggagtctggatctttgtcctgttgaatgggttcattcactggatcatgtacggttactattggacgcggctcatcaagctgaacttccccatgcccaagaacctgatcacctccatgcagatcatccagttcaatgtcgggttctacatcgtctggaagtaccgcaatgtgccatgctaccgccaggatgggatgcgcatgtttgcctggatcttcaactactggtatgtcgggacggtcttgctgctgttcctcaacttttacgtgcagacgtacatccggaagccgaggaagaaccgagggaagaaggagcccgcccgtccagctggactcccgccggccacgtactacgactccctggcagtgagcggccgcaccatgtctcctaagcggcaagctctgccaatcacaattgatggcgcaacttatgatgtgtctgcttgggtcaatcaccaccctggaggagctgacattatcgagaactatcgcaaccgcgatgcgaccgatgtcttcatggtgatgcactctcaagaagccgtcgccaagttgaagagaatgcctgttatggagccttcctctcctgacacacctgttgcacccaagcctaagcgtgatgagccccaggaggatttccgcaagttgcgggaggaattcatctccaagggtatgttcgagacgagtttcctttggtatttttacaagacttcaactaccgtcggtttgatggtcctttccatcttgatgaccgtgtacacgaattggtatttcaccgctgctttggttcttggcgtgtgctaccaacagctaggctggttgtcccacgactattgccatcaccaggttttcacaaaccgcaagattaacgacgctttcggtctctttttcggtaacgtgatgcagggatactcacagacttggtggaaggataggcacaatggtcaccatgccgccaccaatgtggtcggccatgacccagatattgataacctccccatcctggcttggtctcccgaagatgtcaagagggctactccttcgactcggaatctcatcaagtaccagcagtactacttcattcccaccattgcatcccttaggttcatctggtgcctccaatccatcggcggcgtcatgtcctacaagagcgaggagaggaacctgtactacaagcgccagtacactaaggaggcgattggtctggccctccactgggtgctcaaggccactttctattgcagtgccatgcctagctttgccaccggtttgggatgcttcttgatctccgagctgctcggaggatttggcattgccatcgttgtgtttctgaatcactatcctttggacaaggttgaggagactgtctgggatgagcacgggttcagcgccagccagatccacgagacgttgaacattaagcccggccttctcaccgattgggtctttggtggtctcaactaccagattgagcaccacttgtggcccaacatgcccaggcacaacctcacggcagcttccctggaggtgcagaagttgtgcgccaagcacaacctgccctacagggccccagccatcatccccggggttcagaaattggtcagcttcttaggcgagattgcccagctggctgctgtccctgaatgagc

SEQ ID NO: 267 - DNA, 1350 bp, Euglena gracilis
  ref <302>: TITLE: DELTA-5 DESATURASE AND ITS USE IN MAKING POLYUNSATURATED FATTY ACIDS
  ref <310>: PATENT DOCUMENT NUMBER: US-2007-0277266-A1
  ref <311>: PATENT FILING DATE: 2007-05-17
  ref <312>: PUBLICATION DATE: 2007-11-29
  ref <313>: RELEVANT RESIDUES IN SEQ ID NO: (1)..(1350)
  ref <302>: TITLE: DELTA-5 DESATURASE AND ITS USE IN MAKING POLYUNSATURATED FATTY ACIDS
  ref <310>: PATENT DOCUMENT NUMBER: WO 2007/136877
  ref <311>: PATENT FILING DATE: 2007-05-17
  ref <312>: PUBLICATION DATE: 2007-11-29
  ref <313>: RELEVANT RESIDUES IN SEQ ID NO: (1)..(1350)
atggctctcagtcttaccacagaacagctgttagaacgccctgatttggttgcgattgatggcatcctctacgaccttgaagggcttgccaaagttcatccaggaggagatttgattctcgcttctggtgcctctgatgcctcccctctcttttattcgatgcatccatacgtcaaaccggagaattccaaattgcttcaacagttcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgctgactggattcatgcacatgcagatcggcttatccatccagcatgatgcgtcccacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaagcttggtacatgtaccttgtgctgggggcatacggggtatcgctggtgtacaacccgctctacattttccggatgcagcacaatgacaccatcccagagtctgtcacggccatgcgggagaatggctttctgcggcgctaccgcacacttgcattcgtgatgcgagctttcttcatcttccggaccgcattcttgccctggtacctcactgggacctcattgctgatcaccattcctctggtgcccactgcaactggtgccttcttgacgttcttcttcattttgtcccacaattttgatggctccgaacggatccccgacaagaactgcaaggttaagagctctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgccatggagtgcgatatgttttctatcctaccatcgtcggcaacatcatctccaccctgaagtacatgcataaggtgggtgtcgtccactgcgtgaaggacgcacaggattcctga

SEQ ID NO: 268 - DNA, 6615 bp, Artificial Sequence
  Plasmid pKR1237
  misc_feature (4340)..(4340): n is a, c, g, or t
ggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccggtctagaggatccaaggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgcgtacgtgggcggatcccccgggctgcaggaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactcgacgtacgtcctcgaagagaagggttaataacacattttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggccgcaaaccatggctctcagtcttaccacagaacagctgttagaacgccctgatttggttgcgattgatggcatcctctacgaccttgaagggcttgccaaagttcatccaggaggagatttgattctcgcttctggtgcctctgatgcctcccctctcttttattcaatgcatccatacgtcaaaccggagaattccaaattgcttcaacagttcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgttgactggattcatgcacatgcagatcggcttatccatccagcatgatgcgtcccacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaagcttggtacatgtaccttgtgctgggggcatacggggtatcgctggtgtacaacccgctctacattttccggatgcagcacaatgacaccatcccagagtctgtcacggccatgcgggaaaatggctttctgcggcgctaccgcacacttgcattcgtgatgcgagctttcttcatcttccggaccgcattcttgccctggtacctcactgggacctcattgctgatcaccattcctctggtgcccaccgcaactggtgccttcttgacgttcttcttcattttgtcccacaattttgatggctccgaacggatccccgacaagaactgcaaggttaagagatctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgccatggagtgcgatatgttttctaccctaccatcgtcggcaacatcatctccaccctgaagtacatgcataaggtgggtgtcgtccactgcgtgaaggacgcacaggattcctaagc

SEQ ID NO: 269 - DNA, 6464 bp, Artificial Sequence
  Plasmid pKR1252
cgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttggatctcctgcaggatctggccggccggatctcgtacggatccttcatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactccatggaagcagccaaagaattggtttccatcgtccaagaggagctccccaaggtggactatgcccagctttggcaggatgccagcagctgtgaggtcctttacctctcggtggcattcgtggcgatcaagttcatgctgcgcccactggacctgaagcgccaggccaccttgaagaagctgttcacagcatacaacttcctcatgtcgatctattcctttggctccttcctggccatggcctatgccctatcagtaactggcatcctctccggcgactgtgagacggcgttcaacaacgatgtgttcaggatcacaactcagctgttctacctcagcaagttcgtagagtacatcgactccttctaccttccccttatggacaagccactgtcgttccttcagttcttccatcatttgggggcccccattgacatgtggctattctacaaataccgcaacgaaggagtctggatctttgtcctgttgaatgggttcattcactggatcatgtacggttactattggacgcggctcatcaagctgaacttccccatgcccaagaacctgatcacctccatgcagatcatccagttcaatgtcgggttctacatcgtctggaagtaccgcaatgtgccatgctaccgccaggatgggatgcgcatgtttgcctggatcttcaactactggtatgtcgggacggtcttgctgctgttcctcaacttttacgtgcagacgtacatccggaagccgaggaagaaccgagggaagaaggagcccgcccgtccagctggactcccgccggccacgtactacgactccctggcagtgagcggccgcaccatgtctcctaagcggcaagctctgccaatcacaattgatggcgcaacttatgatgtgtctgcttgggtcaatcaccaccctggaggagctgacattatcgagaactatcgcaaccgcgatgcgaccgatgtcttcatggtgatgcactctcaagaagccgtcgccaagttgaagagaatgcctgttatggagccttcctctcctgacacacctgttgcacccaagcctaagcgtgatgagccccaggaggatttccgcaagttgcgggaggaattcatctccaagggtatgttcgagacgagtttcctttggtatttttacaagacttcaactaccgtcggtttgatggtcctttccatcttgatgaccgtgtacacgaattggtatttcaccgctgctttggttcttggcgtgtgctaccaacagctaggctggttgtcccacgactattgccatcaccaggttttcacaaaccgcaagattaacgacgctttcggtctctttttcggtaacgtgatgcagggatactcacagacttggtggaaggataggcacaatggtcaccatgccgccaccaatgtggtcggccatgacccagatattgataacctccccatcctggcttggtctcccgaagatgtcaagagggctactccttcgactcggaatctcatcaagtaccagcagtactacttcattcccaccattgcatcccttaggttcatctggtgcctccaatccatcggcggcgtcatgtcctacaagagcgaggagaggaacctgtactacaagcgccagtacactaaggaggcgattggtctggccctccactgggtgctcaaggccactttctattgcagtgccatgcctagctttgccaccggtttgggatgcttcttgatctccgagctgctcggaggatttggcattgccatcgttgtgtttctgaatcactatcctttggacaaggttgaggagactgtctgggatgagcacgggttcagcgccagccagatccacgagacgttgaacattaagcccggccttctcaccgattgggtctttggtggtctcaactaccagattgagcaccacttgtggcccaacatgcccaggcacaacctcacggcagcttccctggaggtgcagaagttgtgcgccaagcacaacctgccctacagggccccagccatcatccccggggttcagaaattggtcagcttcttaggcgagattgcccagctggctgctgtccctgaatgagcggccgcaagtatgaactaaaatgcacgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaaggaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtaaagcaatggttgaccgtgtgcttagcttcttttattttatttttttatcagcaaagaataaataaaataaaatgagacacttcagggatgtttcaacggatccgtcgacgg

SEQ ID NO: 270 - DNA, 10387 bp, Artificial Sequence
  Plasmid pKR1253
  misc_feature (9212)..(9212): n is a, c, g, or t
gtacggatccttcatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactccatggaagcagccaaagaattggtttccatcgtccaagaggagctccccaaggtggactatgcccagctttggcaggatgccagcagctgtgaggtcctttacctctcggtggcattcgtggcgatcaagttcatgctgcgcccactggacctgaagcgccaggccaccttgaagaagctgttcacagcatacaacttcctcatgtcgatctattcctttggctccttcctggccatggcctatgccctatcagtaactggcatcctctccggcgactgtgagacggcgttcaacaacgatgtgttcaggatcacaactcagctgttctacctcagcaagttcgtagagtacatcgactccttctaccttccccttatggacaagccactgtcgttccttcagttcttccatcatttgggggcccccattgacatgtggctattctacaaataccgcaacgaaggagtctggatctttgtcctgttgaatgggttcattcactggatcatgtacggttactattggacgcggctcatcaagctgaacttccccatgcccaagaacctgatcacctccatgcagatcatccagttcaatgtcgggttctacatcgtctggaagtaccgcaatgtgccatgctaccgccaggatgggatgcgcatgtttgcctggatcttcaactactggtatgtcgggacggtcttgctgctgttcctcaacttttacgtgcagacgtacatccggaagccgaggaagaaccgagggaagaaggagcccgcccgtccagctggactcccgccggccacgtactacgactccctggcagtgagcggccgcaccatgtctcctaagcggcaagctctgccaatcacaattgatggcgcaacttatgatgtgtctgcttgggtcaatcaccaccctggaggagctgacattatcgagaactatcgcaaccgcgatgcgaccgatgtcttcatggtgatgcactctcaagaagccgtcgccaagttgaagagaatgcctgttatggagccttcctctcctgacacacctgttgcacccaagcctaagcgtgatgagccccaggaggatttccgcaagttgcgggaggaattcatctccaagggtatgttcgagacgagtttcctttggtatttttacaagacttcaactaccgtcggtttgatggtcctttccatcttgatgaccgtgtacacgaattggtatttcaccgctgctttggttcttggcgtgtgctaccaacagctaggctggttgtcccacgactattgccatcaccaggttttcacaaaccgcaagattaacgacgctttcggtctctttttcggtaacgtgatgcagggatactcacagacttggtggaaggataggcacaatggtcaccatgccgccaccaatgtggtcggccatgacccagatattgataacctccccatcctggcttggtctcccgaagatgtcaagagggctactccttcgactcggaatctcatcaagtaccagcagtactacttcattcccaccattgcatcccttaggttcatctggtgcctccaatccatcggcggcgtcatgtcctacaagagcgaggagaggaacctgtactacaagcgccagtacactaaggaggcgattggtctggccctccactgggtgctcaaggccactttctattgcagtgccatgcctagctttgccaccggtttgggatgcttcttgatctccgagctgctcggaggatttggcattgccatcgttgtgtttctgaatcactatcctttggacaaggttgaggagactgtctgggatgagcacgggttcagcgccagccagatccacgagacgttgaacattaagcccggccttctcaccgattgggtctttggtggtctcaactaccagattgagcaccacttgtggcccaacatgcccaggcacaacctcacggcagcttccctggaggtgcagaagttgtgcgccaagcacaacctgccctacagggccccagccatcatccccggggttcagaaattggtcagcttcttaggcgagattgcccagctggctgctgtccctgaatgagcggccgcaagtatgaactaaaatgcacgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaaggaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtaaagcaatggttgaccgtgtgcttagcttcttttattttatttttttatcagcaaagaataaataaaataaaatgagacacttcagggatgtttcaacggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttggatctcctgcaggatctggccggccggatctcgtacgcaaaggcaaagatttaaactcgaaaacattacaaaagtctcaaaacagaggcaaggccatgcacaaagcacactctaagtgcttccattgcctactaagtagggtacgtacacgatcaccattcaccagtgatgatctttattaatatacaacacactcagagacagcttatgttatagctagctagcataaactatcacatcatgtgttagtacgacaagtgacaacattgcttttaacttcgcggccttggatcctctagaccggatataatgagccgtaaacaaagatgattaagtagtaattaatacgtactagtaaaagtggcaaaagataacgagaaagaaccaatttctttgcattcggccttagcggaaggcatatataagctttgattattttatttagtgtaatgatttcgtacaaccaaagcatttatttagtactctcacacttgtgtcgcggccgcttaggaatcctgtgcgtccttcacgcagtggacgacacccaccttatgcatgtacttcagggtggagatgatgttgccgacgatggtagggtagaaaacatatcgcactccatggcgttcgcaacactcccggaccgcctgctggacgaaggggtagtgccaagacgacatccggggaaagaggtggtgctcgatctggaaattgagaccgccagtgaagaacatggcgatggggccaccgtatgtggaggacgtctccacctgcgcccgataccagtcaatttggtcagcctcaacgtccttctcagatctcttaaccttgcagttcttgtcggggatccgttcggagccatcaaaattgtgggacaaaatgaagaagaacgtcaagaaggcaccagttgcggtgggcaccagaggaatggtgatcagcaatgaggtcccagtgaggtaccagggcaagaatgcggtccggaagatgaagaaagctcgcatcacgaatgcaagtgtgcggtagcgccgcagaaagccattttcccgcatggccgtgacagactctgggatggtgtcattgtgctgcatccggaaaatgtagagcgggttgtacaccagcgataccccgtatgcccccagcacaaggtacatgtaccaagcttggaagcggtggaaccactttcgggcggtgtttgcggcggggtagttgtggaacaccaggaacggctctgccgactccgcatccaggtcgaggccgtgctggttggtgtaggtgtggtgccgcatgatgtgcgactgcagccaaatccaccgggacgatccgatgacgtcaatgccgtaggcgaagagggcgttgacccaaggcttcttgctgatggccccgtgggacgcatcatgctggatggataagccgatctgcatgtgcatgaatccagtcaacaggccccacagcaccatccccgtggtagcccagtgccactcgcaaaaggccgtcacggcgatgatcccaacggtgcgcagccagaagccaggggttgcgtaccagttcctccctttcatcacctcgcgcattgtccgcttaacgtcttgtgcgaagggagaatcatacgtgtagacaatgtccttcgaggtgcggtcatgcttccctcggacgaactgttgaagcaatttggaattctccggtttgacgtatggatgcattgaataaaagagaggggaggcatcagaggcaccagaagcgagaatcaaatctcctcctggatgaactttggcaagcccttcaaggtcgtagaggatgccatcaatcgcaaccaaatcagggcgttctaacagctgttctgtggtaagactgagagccatggtttgcggccgcttggggggctatggaagactttcttagttagttgtgtgaataagcaatgttgggagaatcgggactacttataggataggaataaaacagaaaagtattaagtgctaatgaaatatttagactgataattaaaatcttcacgtatgtccacttgatataaaaacgtcaggaataaaggaagtacagtagaatttaaaggtactctttttatatatacccgtgttctctttttggctagctagttgcataaaaaataatctatatttttatcattattttaaatatcttatgagatggtaaatatttatcataattttttttactattatttattatttgtgtgtgtaatacatatagaagttaattacaaattttatttactttttcattattttgatatgattcaccattaatttagtgttattatttataatagttcattttaatctttttgtatatattatgcgtgcagtacttttttcctacatataactactattacattttatttatataatatttttattaatgaattttcgtgataatatgtaatattgttcattattatttcagattttttaaaaatatttgtgttattatttatgaaatatgtaatttttttagtatttgattttatgatgataaagtgttctaaattcaaaagaagggggaaagcgtaaacattaaaaaacgtcatcaaacaaaaacaaaatcttgttaataaagataaaactgtttgttttgatcactgttatttcgtaatataaaaacattatttatatttatattgttgacaaccaaatttgcctatcaaatctaaccaatataatgcatgcgtggcaggtaatgtactaccatgaacttaagtcatgacataataaaccgtgaatctgaccaatgcatgtacctanctaaattgtatttgtgacacgaagcaaatgattcaattcacaatggagatgggaaacaaataatgaagaacccagaactaagaaagcttttctgaaaaataaaataaaggcaatgtcaaaagtatactgcatcatcagtccagaaagcacatgatatttttttatcagtatcaatgcagctagttttattttacaatatcgatatagctagtttaaatatattgcagctagatttataaatatttgtgttattatttatcatttgtgtaatcctgtttttagtattttagtttatatatgatgataatgtattccaaatttaaaagaagggaaataaatttaaacaagaaaaaaagtcatcaaacaaaaaacaaatgaaagggtggaaagatgttaccatgtaatgtgaatgttacagtatttcttttattatagagttaacaaattaactaatatgattttgttaataatgataaaatattttttttattattatttcataatataaaaatagtttacttaatataaaaaaaattctatcgttcacaacaaagttggccacctaatttaaccatgcatgtacccatggaccatattaggtaaccatcaaacctgatgaagagataaagagatgaagacttaagtcataacacaaaaccataaaaaacaaaaatacaatcaaccgtcaatctgaccaatgcatgaaaaagctgcaatagtgagtggcgacacaaagcacatgattttcttacaacggagataaaaccaaaaaaatatttcatgaacaacctagaacaaataaagcttttatataataaatatataaataaataaaggctatggaataatatacttcaatatatttggattaaataaattgttggcggggttgatatatttatacacacctaaagtcacttcaatctcattttcacttaacttttattttttttttctttttatttatcataaagagaatattgataatatactttttaacatatttttatgacattttttattggtgaaaacttattaaaaatcataaattttgtaagttagatttatttaaagagttcctcttcttattttaaattttttaataaatttttaaataactaaaatttgtgttaaaaatgttaaaaaatgtgttattaacccttctcttcgaggac

SEQ ID NO: 271 - DNA, 30 bp, Artificial Sequence
  oEAd5-1-1 primer
agcggccgcaccatggccaccatctctttg

SEQ ID NO: 272 - DNA, 30 bp, Artificial Sequence
  oEAd5-1-2 primer
tgcggccgctcagaattcctgggcatcctg

SEQ ID NO: 273 - DNA, 4899 bp, Artificial Sequence
  Plasmid pKR1136
aattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaagcccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgtatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgccagtgtgatggatatctgcagaattcaggagcggccgcaccatggccaccatctctttgactactgagcaacttttagaacacccagaactggttgcaattgatggggtgttgtacgatctcttcggactggcgaaagtgcatccaggtggcaacctcattgaagccgccggtgcctccgacggaaccgccctgttctactccatgcaccctggagtgaagccagagaattcgaagctgctgcagcaatttgcccgaggcaaacacgaacgaagctcgaaggacccagtgtacacctttgacagtcccttcgcccaggatgtcaagcagagcgttcgggaggtcatgaaggggcgcaactggtacgccacgcccggcttttggctgcggaccgcgctgatcatcgcgtgcactgccataggcgaatggtattggatcactaccggggcagtgatgtggggcatcttcaccgggtacttccacagccagattgggttggcgattcaacacgatgcctctcacggagccatcagcaaaaagccctgggtgaacgcctttttcgcctacggcatcgacgccattggatcctcccgctggatctggctgcagtcccacattatgcgccaccacacctacaccaaccagcatggcctggacctggacgctgcctcggcggagccgttcattttgttccactcctacccggcaacaaatgcgtcacgaaagtggtaccatcggttccaggcgtggtacatgtacatcgttttggggatgtatggtgtgtcgatggtgtacaatccgatgtacttgttcacgatgcagcacaacgacacaatcccagaggccacctctcttagaccaggcagctttttcaaccggcagcgcgccttcgccgtttccctccgcctactgttcatcttccgcaacgccttcctcccctggtacatcgcgggcgcctctccgctgctcaccatcctgctggtgccaacggtcacaggcatcttcttgacatttgtttttgtgctgtcccataactttgaaggcgctgagcggacccccgaaaagaactgcaaggccaaaagggccaaggaggggaaggaggtccgcgatgtagaggaggaccgggtggactggtaccgggcgcaggccgagaccgcggcgacctacgggggcagcgtcgggatgatgctgaccggcggtttgaacctgcagatcgagcaccacttgttcccccgcatgtcctcttggcactaccccttcatccaagatacggtgcgggaatgttgcaagcgccatggcgtgcgctacacatactacccgaccatcctggagaatataatgtccacgctccgctacatgcagaaggtgggcgtggcccacacaattcaggatgcccaggaattctgagcggccgcacctg

SEQ ID NO: 274 - DNA, 5592 bp, Artificial Sequence
  Plasmid pKR1139
ggccgcatttcgcaccaaatcaatgaaagtaataatgaaaagtctgaataagaatacttaggcttagatgcctttgttacttgtgtaaaataacttgagtcatgtacctttggcggaaacagaataaataaaaggtgaaattccaatgctctatgtataagttagtaatacttaatgtgttctacggttgtttcaatatcatcaaactctaattgaaactttagaaccacaaatctcaatcttttcttaatgaaatgaaaaatcttaattgtaccatgtttatgttaaacaccttacaattaattggttggagaggaggaccaaccgatgggacaacattgggagaaagagattcaatggagatttggataggagaacaacattctttttcacttcaatacaagatgagtgcaacactaaggatatgtatgagactttcagaagctacgacaacatagatgagtgaggtggtgattcctagcaagaaagacattagaggaagccaaaatcgaacaaggaagacatcaagggcaagagacaggaccatccatctcaggaaaaggagctttgggatagtccgagaagttgtacaagaaattttttggagggtgagtgatgcattgctggtgactttaactcaatcaaaattgagaaagaaagaaaagggagggggctcacatgtgaatagaagggaaacgggagaattttacagttttgatctaatgggcatcccagctagtggtaacatattcaccatgtttaaccttcacgtacgtctagaggatcccccatggtcaatcaatgagacgccaacttcttaatctattgagacctgcaggtctagaagggcggatccccgggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgcggccgcaccatggccaccatctctttgactactgagcaacttttagaacacccagaactggttgcaattgatggggtgttgtacgatctcttcggactggcgaaagtgcatccaggtggcaacctcattgaagccgccggtgcctccgacggaaccgccctgttctactccatgcaccctggagtgaagccagagaattcgaagctgctgcagcaatttgcccgaggcaaacacgaacgaagctcgaaggacccagtgtacacctttgacagtcccttcgcccaggatgtcaagcagagcgttcgggaggtcatgaaggggcgcaactggtacgccacgcccggcttttggctgcggaccgcgctgatcatcgcgtgcactgccataggcgaatggtattggatcactaccggggcagtgatgtggggcatcttcaccgggtacttccacagccagattgggttggcgattcaacacgatgcctctcacggagccatcagcaaaaagccctgggtgaacgcctttttcgcctacggcatcgacgccattggatcctcccgctggatctggctgcagtcccacattatgcgccaccacacctacaccaaccagcatggcctggacctggacgctgcctcggcggagccgttcattttgttccactcctacccggcaacaaatgcgtcacgaaagtggtaccatcggttccaggcgtggtacatgtacatcgttttggggatgtatggtgtgtcgatggtgtacaatccgatgtacttgttcacgatgcagcacaacgacacaatcccagaggccacctctcttagaccaggcagctttttcaaccggcagcgcgccttcgccgtttccctccgcctactgttcatcttccgcaacgccttcctcccctggtacatcgcgggcgcctctccgctgctcaccatcctgctggtgccaacggtcacaggcatcttcttgacatttgtttttgtgctgtcccataactttgaaggcgctgagcggacccccgaaaagaactgcaaggccaaaagggccaaggaggggaaggaggtccgcgatgtagaggaggaccgggtggactggtaccgggcgcaggccgagaccgcggcgacctacgggggcagcgtcgggatgatgctgaccggcggtttgaacctgcagatcgagcaccacttgttcccccgcatgtcctcttggcactaccccttcatccaagatacggtgcgggaatgttgcaagcgccatggcgtgcgctacacatactacccgaccatcctggagaatataatgtccacgctccgctacatgcagaaggtgggcgtggcccacacaattcaggatgcccaggaattctgagc

SEQ ID NO: 275 - DNA, 13293 bp, Artificial Sequence
  Plasmid pKR1255
  misc_feature (2769)..(2769): n is a, c, g, or t
ggatctggccggccggatctcgtacgcaaaggcaaagatttaaactcgaaaacattacaaaagtctcaaaacagaggcaaggccatgcacaaagcacactctaagtgcttccattgcctactaagtagggtacgtacacgatcaccattcaccagtgatgatctttattaatatacaacacactcagagacagcttatgttatagctagctagcataaactatcacatcatgtgttagtacgacaagtgacaacattgcttttaacttcgcggccttggatcctctagaccggatataatgagccgtaaacaaagatgattaagtagtaattaatacgtactagtaaaagtggcaaaagataacgagaaagaaccaatttctttgcattcggccttagcggaaggcatatataagctttgattattttatttagtgtaatgatttcgtacaaccaaagcatttatttagtactctcacacttgtgtcgcggccgcttaggaatcctgtgcgtccttcacgcagtggacgacacccaccttatgcatgtacttcagggtggagatgatgttgccgacgatggtagggtagaaaacatatcgcactccatggcgttcgcaacactcccggaccgcctgctggacgaaggggtagtgccaagacgacatccggggaaagaggtggtgctcgatctggaaattgagaccgccagtgaagaacatggcgatggggccaccgtatgtggaggacgtctccacctgcgcccgataccagtcaatttggtcagcctcaacgtccttctcagatctcttaaccttgcagttcttgtcggggatccgttcggagccatcaaaattgtgggacaaaatgaagaagaacgtcaagaaggcaccagttgcggtgggcaccagaggaatggtgatcagcaatgaggtcccagtgaggtaccagggcaagaatgcggtccggaagatgaagaaagctcgcatcacgaatgcaagtgtgcggtagcgccgcagaaagccattttcccgcatggccgtgacagactctgggatggtgtcattgtgctgcatccggaaaatgtagagcgggttgtacaccagcgataccccgtatgcccccagcacaaggtacatgtaccaagcttggaagcggtggaaccactttcgggcggtgtttgcggcggggtagttgtggaacaccaggaacggctctgccgactccgcatccaggtcgaggccgtgctggttggtgtaggtgtggtgccgcatgatgtgcgactgcagccaaatccaccgggacgatccgatgacgtcaatgccgtaggcgaagagggcgttgacccaaggcttcttgctgatggccccgtgggacgcatcatgctggatggataagccgatctgcatgtgcatgaatccagtcaacaggccccacagcaccatccccgtggtagcccagtgccactcgcaaaaggccgtcacggcgatgatcccaacggtgcgcagccagaagccaggggttgcgtaccagttcctccctttcatcacctcgcgcattgtccgcttaacgtcttgtgcgaagggagaatcatacgtgtagacaatgtccttcgaggtgcggtcatgcttccctcggacgaactgttgaagcaatttggaattctccggtttgacgtatggatgcattgaataaaagagaggggaggcatcagaggcaccagaagcgagaatcaaatctcctcctggatgaactttggcaagcccttcaaggtcgtagaggatgccatcaatcgcaaccaaatcagggcgttctaacagctgttctgtggtaagactgagagccatggtttgcggccgcttggggggctatggaagactttcttagttagttgtgtgaataagcaatgttgggagaatcgggactacttataggataggaataaaacagaaaagtattaagtgctaatgaaatatttagactgataattaaaatcttcacgtatgtccacttgatataaaaacgtcaggaataaaggaagtacagtagaatttaaaggtactctttttatatatacccgtgttctctttttggctagctagttgcataaaaaataatctatatttttatcattattttaaatatcttatgagatggtaaatatttatcataattttttttactattatttattatttgtgtgtgtaatacatatagaagttaattacaaattttatttactttttcattattttgatatgattcaccattaatttagtgttattatttataatagttcattttaatctttttgtatatattatgcgtgcagtacttttttcctacatataactactattacattttatttatataatatttttattaatgaattttcgtgataatatgtaatattgttcattattatttcagattttttaaaaatatttgtgttattatttatgaaatatgtaatttttttagtatttgattttatgatgataaagtgttctaaattcaaaagaagggggaaagcgtaaacattaaaaaacgtcatcaaacaaaaacaaaatcttgttaataaagataaaactgtttgttttgatcactgttatttcgtaatataaaaacattatttatatttatattgttgacaaccaaatttgcctatcaaatctaaccaatataatgcatgcgtggcaggtaatgtactaccatgaacttaagtcatgacataataaaccgtgaatctgaccaatgcatgtacctanctaaattgtatttgtgacacgaagcaaatgattcaattcacaatggagatgggaaacaaataatgaagaacccagaactaagaaagcttttctgaaaaataaaataaaggcaatgtcaaaagtatactgcatcatcagtccagaaagcacatgatatttttttatcagtatcaatgcagctagttttattttacaatatcgatatagctagtttaaatatattgcagctagatttataaatatttgtgttattatttatcatttgtgtaatcctgtttttagtattttagtttatatatgatgataatgtattccaaatttaaaagaagggaaataaatttaaacaagaaaaaaagtcatcaaacaaaaaacaaatgaaagggtggaaagatgttaccatgtaatgtgaatgttacagtatttcttttattatagagttaacaaattaactaatatgattttgttaataatgataaaatattttttttattattatttcataatataaaaatagtttacttaatataaaaaaaattctatcgttcacaacaaagttggccacctaatttaaccatgcatgtacccatggaccatattaggtaaccatcaaacctgatgaagagataaagagatgaagacttaagtcataacacaaaaccataaaaaacaaaaatacaatcaaccgtcaatctgaccaatgcatgaaaaagctgcaatagtgagtggcgacacaaagcacatgattttcttacaacggagataaaaccaaaaaaatatttcatgaacaacctagaacaaataaagcttttatataataaatatataaataaataaaggctatggaataatatacttcaatatatttggattaaataaattgttggcggggttgatatatttatacacacctaaagtcacttcaatctcattttcacttaacttttattttttttttctttttatttatcataaagagaatattgataatatactttttaacatatttttatgacattttttattggtgaaaacttattaaaaatcataaattttgtaagttagatttatttaaagagttcctcttcttattttaaattttttaataaatttttaaataactaaaatttgtgttaaaaatgttaaaaaatgtgttattaacccttctcttcgaggacgtacggatccttcatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactccatggaagcagccaaagaattggtttccatcgtccaagaggagctccccaaggtggactatgcccagctttggcaggatgccagcagctgtgaggtcctttacctctcggtggcattcgtggcgatcaagttcatgctgcgcccactggacctgaagcgccaggccaccttgaagaagctgttcacagcatacaacttcctcatgtcgatctattcctttggctccttcctggccatggcctatgccctatcagtaactggcatcctctccggcgactgtgagacggcgttcaacaacgatgtgttcaggatcacaactcagctgttctacctcagcaagttcgtagagtacatcgactccttctaccttccccttatggacaagccactgtcgttccttcagttcttccatcatttgggggcccccattgacatgtggctattctacaaataccgcaacgaaggagtctggatctttgtcctgttgaatgggttcattcactggatcatgtacggttactattggacgcggctcatcaagctgaacttccccatgcccaagaacctgatcacctccatgcagatcatccagttcaatgtcgggttctacatcgtctggaagtaccgcaatgtgccatgctaccgccaggatgggatgcgcatgtttgcctggatcttcaactactggtatgtcgggacggtcttgctgctgttcctcaacttttacgtgcagacgtacatccggaagccgaggaagaaccgagggaagaaggagcccgcccgtccagctggactcccgccggccacgtactacgactccctggcagtgagcggccgcaccatgtctcctaagcggcaagctctgccaatcacaattgatggcgcaacttatgatgtgtctgcttgggtcaatcaccaccctggaggagctgacattatcgagaactatcgcaaccgcgatgcgaccgatgtcttcatggtgatgcactctcaagaagccgtcgccaagttgaagagaatgcctgttatggagccttcctctcctgacacacctgttgcacccaagcctaagcgtgatgagccccaggaggatttccgcaagttgcgggaggaattcatctccaagggtatgttcgagacgagtttcctttggtatttttacaagacttcaactaccgtcggtttgatggtcctttccatcttgatgaccgtgtacacgaattggtatttcaccgctgctttggttcttggcgtgtgctaccaacagctaggctggttgtcccacgactattgccatcaccaggttttcacaaaccgcaagattaacgacgctttcggtctctttttcggtaacgtgatgcagggatactcacagacttggtggaaggataggcacaatggtcaccatgccgccaccaatgtggtcggccatgacccagatattgataacctccccatcctggcttggtctcccgaagatgtcaagagggctactccttcgactcggaatctcatcaagtaccagcagtactacttcattcccaccattgcatcccttaggttcatctggtgcctccaatccatcggcggcgtcatgtcctacaagagcgaggagaggaacctgtactacaagcgccagtacactaaggaggcgattggtctggccctccactgggtgctcaaggccactttctattgcagtgccatgcctagctttgccaccggtttgggatgcttcttgatctccgagctgctcggaggatttggcattgccatcgttgtgtttctgaatcactatcctttggacaaggttgaggagactgtctgggatgagcacgggttcagcgccagccagatccacgagacgttgaacattaagcccggccttctcaccgattgggtctttggtggtctcaactaccagattgagcaccacttgtggcccaacatgcccaggcacaacctcacggcagcttccctggaggtgcagaagttgtgcgccaagcacaacctgccctacagggccccagccatcatccccggggttcagaaattggtcagcttcttaggcgagattgcccagctggctgctgtccctgaatgagcggccgcaagtatgaactaaaatgcacgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaaggaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtaaagcaatggttgaccgtgtgcttagcttcttttattttatttttttatcagcaaagaataaataaaataaaatgagacacttcagggatgtttcaacggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttggatctcctgcaggtctcaatagattaagaagttggcgtctcattgattgaccatgggggatcctctagacgtacgtgaaggttaaacatggtgaatatgttaccactagctgggatgcccattagatcaaaactgtaaaattctcccgtttcccttctattcacatgtgagccccctcccttttctttctttctcaattttgattgagttaaagtcaccagcaatgcatcactcaccctccaaaaaatttcttgtacaacttctcggactatcccaaagctccttttcctgagatggatggtcctgtctcttgcccttgatgtcttccttgttcgattttggcttcctctaatgtctttcttgctaggaatcaccacctcactcatctatgttgtcgtagcttctgaaagtctcatacatatccttagtgttgcactcatcttgtattgaagtgaaaaagaatgttgttctcctatccaaatctccattgaatctctttctcccaatgttgtcccatcggttggtcctcctctccaaccaattaattgtaaggtgtttaacataaacatggtacaattaagatttttcatttcattaagaaaagattgagatttgtggttctaaagtttcaattagagtttgatgatattgaaacaaccgtagaacacattaagtattactaacttatacatagagcattggaatttcaccttttatttattctgtttccgccaaaggtacatgactcaagttattttacacaagtaacaaaggcatctaagcctaagtattcttattcagacttttcattattactttcattgatttggtgcgaaatgcggccgctcagaattcctgggcatcctgaattgtgtgggccacgcccaccttctgcatgtagcggagcgtggacattatattctccaggatggtcgggtagtatgtgtagcgcacgccatggcgcttgcaacattcccgcaccgtatcttggatgaaggggtagtgccaagaggacatgcgggggaacaagtggtgctcgatctgcaggttcaaaccgccggtcagcatcatcccgacgctgcccccgtaggtcgccgcggtctcggcctgcgcccggtaccagtccacccggtcctcctctacatcgcggacctccttcccctccttggcccttttggccttgcagttcttttcgggggtccgctcagcgccttcaaagttatgggacagcacaaaaacaaatgtcaagaagatgcctgtgaccgttggcaccagcaggatggtgagcagcggagaggcgcccgcgatgtaccaggggaggaaggcgttgcggaagatgaacagtaggcggagggaaacggcgaaggcgcgctgccggttgaaaaagctgcctggtctaagagaggtggcctctgggattgtgtcgttgtgctgcatcgtgaacaagtacatcggattgtacaccatcgacacaccatacatccccaaaacgatgtacatgtaccacgcctggaaccgatggtaccactttcgtgacgcatttgttgccgggtaggagtggaacaaaatgaacggctccgccgaggcagcgtccaggtccaggccatgctggttggtgtaggtgtggtggcgcataatgtgggactgcagccagatccagcgggaggatccaatggcgtcgatgccgtaggcgaaaaaggcgttcacccagggctttttgctgatggctccgtgagaggcatcgtgttgaatcgccaacccaatctggctgtggaagtacccggtgaagatgccccacatcactgccccggtagtgatccaataccattcgcctatggcagtgcacgcgatgatcagcgcggtccgcagccaaaagccgggcgtggcgtaccagttgcgccccttcatgacctcccgaacgctctgcttgacatcctgggcgaagggactgtcaaaggtgtacactgggtccttcgagcttcgttcgtgtttgcctcgggcaaattgctgcagcagcttcgaattctctggcttcactccagggtgcatggagtagaacagggcggttccgtcggaggcaccggcggcttcaatgaggttgccacctggatgcactttcgccagtccgaagagatcgtacaacaccccatcaattgcaaccagttctgggtgttctaaaagttgctcagtagtcaaagagatggtggccatggtgcggccgcggtgatgactgatgagtgtttaaggaccaatggagagaatgtttgagttgtgaagcggagaacctgaggcgtggttatttatagggaagagaggaaggtgaatgagggacacgtcacagaagtagggtgctgagcttgagacattcttcagtatgcatggctatggaagccttgggtgctacacctcatgaagttcatggtgtgaggtggcttcggcatctcaattaagtgacaaagagaaaggtgtttcagtgtttctattgcaaatggcagaaactcgtgatgacgaggggaccatgcatggtttcatttcttttcttcctggattctttctttccttttatatatgcaggttcataatttaaaaattagactcgctttcaatttcttaatttctcattttcctcttatattactgtactaatgttaaccacgtacacttattttttttttagtttaattttgatagattgtgttgatttaaacatattaatattttcaaccaaataaaaatcattttagtagatacggctttttaaataattattaaaaatattaactatttatcctaaatggcacattttaattaaaaaaaatccggtgttgtaagtgttttattaatttgttttggcattattaaagcaactttttttttatttgttggcattttgagtacgtacttaggctagcctgca

SEQ ID NO: 276 - DNA, 7497 bp, Artificial Sequence
  Plasmid pKR561
gtacgtcgagtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttggatcctctagacgtacggtaccatctgctaatattttaaatcacatgcaagagaggaggcatggttccattttctaccttcacattatttgagaaaaacgaacttgttctgtgttttatttttgcccttcacattagtacaacgtggaagactcatggttacacagaatcatacataagtacaatgcttgtccctaagaaaacaagcactcgttgtattgaacctttacggctcatgcggccgctgaagtattgcttcttagttaacctttcctttctctctcagctatgtgaattcattttgctttcgtcacaatttatatagtgaaattggatctttggagttaacgccttcacaggattatcgtgttagaacaatgctttttcatgttctaattagtagtacattacaaatgtgcactctattcaataagcatcttttggcacgttaataaatcatgtgaaaaaaaaatactactatttcaaagaaagtgttgtaaaaagaaacggaaagagagctggcttcagttgttgagacttgtttgctagtaaaaatggtgtgaagagtgattcatggtgaggtggtttttcgtccctttctgtttgcatgaaaaacaaatggcaagagatgacgtaggattccttcccttaacgattatctgtttttaatttcaaatatacatataggaatttatgaattactaaggttgtaaaatatgctggtcatttatttatggctaaaatatttttttttctcgtaaatataaaaatatttaaaatttatttttatcatattttttatccttataaaattatgtgtacaacctatataaaaaaatatcatatttaatattgattatatgtttaatcaatataaaaaatcattatcatatatttagatttattcgaatatacatctaaacaaaaaataacatattttaattttatgaagaaaaaaaaatattttatcctttatttatttaagattaattaatagttatgtattgtggaaagacttttacacatgcaatagatatactgaatcaattagatgccaatgctgagttggaaatcacttgaggaggggaggagacttgccaatgcttttcagtttcatttaaatgatttagtggaggagatagagtagtgataaaggcatgccccaattttggagtgtatatatgagtggaaataagagagggatagagagaaaaaataaagagagtaaaaataattaatgtgaaatgatatgataaaaaaataaagaaagagataaagagaaaaatgaaatgagagatagatgaaatagagagtagatacatgtttgtttaggttttttttaggaaataacacatttttttctcatcacttattactcactgtcaatttcctctctttcaatcataatgatatgatttgtttaacaaaaatgtgaaaaaacatataaagtaaaatatttttataaattgataaataaaaatttacaaaatttatttcttattaaattgaatagaaaatgaaagaaaagaaaagaaaaagtatatataaaatgatatagctttaaaaagaataaatttttcatatcagtctttttttaataatttagaaatatttaagtatatagcaaaaatataatgtactttacatatgcataaataataatttgaaaatagaactaatagaatagagaaaaaagtaatataataattaactatatgaaaatttagaagggacaatatttttaattaagaatataaacaatatttcttttcatgtaatgagggacggatgtacggggccagtgttggagtcaaagccaaaatagtcacggggaaattaatgcactgcatgactattcgaaaaaattcactagccttacttagatgttagattaatagctagggggtgcagataattttgaaaggcatgaaaaacattaatttgtacattgcaagcttttgatgacaagctttgcaattgttcacactaccttatgccatttataaatagagtgattggcatatgaaggaaatcatgagagtcgaagcgaaaaacaaagcttgagagtgtaggaaaaatacagtttttttggtaaaaatacagtatttgaataggagcgaaaaatatcctttcaaaatgatccttttctttttttttttttttcttgttgttcttggtcagttattcaaaggaaaagggattgaaataaaaacttgcatgtgggatc

SEQ ID NO: 277 - DNA, 1143 bp, Glycine max
atggttaaagacacaaagcctttagcctatgctgccaataatggataccaacaaaagggttcttcttttgattttgatcctagcgctcctccaccgtttaagattgcagaaatcagagcttcaataccaaaacattgctgggtcaagaatccatggagatccctcagttatgttctcagggatgtgcttgtaattgctgcattggtggctgcagcaattcacttcgacaactggcttctctggctaatctattgccccattcaaggcacaatgttctgggctctctttgttcttggacatgattgtggccatggaagcttttcagatagccctttgctgaatagcctggtgggacacatcttgcattcctcaattcttgtgccataccatggatggagaattagccacagaactcaccatcaaaaccatggacacattgagaaggatgagtcatgggttccattaacagagaagatttacaagaatctagacagcatgacaagactcattagattcactgtgccatttccattgtttgtgtatccaatttatttgttttcaagaagccccggaaaggaaggctctcacttcaatccctacagcaatctgttcccacccagtgagagaaaaggaatagcaatatcaacactgtgttgggctaccatgttttctctgcttatctatctctcattcataactagtccacttctagtgctcaagctctatggaattccatattggatatttgttatgtggctggactttgtcacatacttgcatcaccatggtcaccaccagaaactgccttggtaccgcggcaaggaatggagttatttaagaggtggcctcaccactgtggatcgtgactatggttggatctataacattcaccatgacattggcacccatgttatccaccatcttttcccccaaattcctcattatcacctcgttgaagcgacacaagcagcaaaaccagttcttggagattactaccgtgagccagaaagatctgcgccattaccatttcatctaataaagtatttaattcagagtatgagacaagaccacttcgtaagtgacactggagatgttgtttattatcagactgattctctgctcctccactcgcaacgagactga

SEQ ID NO: 278 - DNA, 32 bp, Artificial Sequence
  HPfad3-1 primer
gcggccgcgttaaagacacaaagcctttagcc

SEQ ID NO: 279 - DNA, 34 bp, Artificial Sequence
  HPfad3-2 primer
gattgtggccatggaaggagatagataagcagag

SEQ ID NO: 280 - DNA, 709 bp, Artificial Sequence
  HPfad3AB amplicon
gcggccgcgttaaagacacaaagcctttagcctatgctgccaataatggataccaacaaaagggttcttcttttgattttgatcctagcgctcctccaccgtttaagattgcagaaatcagagcttcaataccaaaacattgctgggtcaagaatccatggagatccctcagttatgttctcagggatgtgcttgtaattgctgcattggtggctgcagcaattcacttcgacaactggcttctctggctaatctattgccccattcaaggcacaatgttctgggctctctttgttcttggacatgattgtggccatggaagcttttcagatagccctttgctgaatagcctggtgggacacatcttgcattcctcaattcttgtgccataccatggatggagaattagccacagaactcaccatcaaaaccatggacacattgagaaggatgagtcatgggttccattaacagagaagatttacaagaatctagacagcatgacaagactcattagattcactgtgccatttccattgtttgtgtatccaatttatttgttttcaagaagccccggaaaggaaggctctcacttcaatccctacagcaatctgttcccacccagtgagagaaaaggaatagcaatatcaacactgtgttgggctaccatgttttctctgcttatctatctccttccatggccacaatc

SEQ ID NO: 281 - DNA, 34 bp, Artificial Sequence
  HPfad3-3 primer
ctctgcttatctatctccttccatggccacaatc

SEQ ID NO: 282 - DNA, 709 bp, Artificial Sequence
  HPfad3A'-2 amplicon
gattgtggccatggaaggagatagataagcagagaaaacatggtagcccaacacagtgttgatattgctattccttttctctcactgggtgggaacagattgctgtagggattgaagtgagagccttcctttccggggcttcttgaaaacaaataaattggatacacaaacaatggaaatggcacagtgaatctaatgagtcttgtcatgctgtctagattcttgtaaatcttctctgttaatggaacccatgactcatccttctcaatgtgtccatggttttgatggtgagttctgtggctaattctccatccatggtatggcacaagaattgaggaatgcaagatgtgtcccaccaggctattcagcaaagggctatctgaaaagcttccatggccacaatcatgtccaagaacaaagagagcccagaacattgtgccttgaatggggcaatagattagccagagaagccagttgtcgaagtgaattgctgcagccaccaatgcagcaattacaagcacatccctgagaacataactgagggatctccatggattcttgacccagcaatgttttggtattgaagctctgatttctgcaatcttaaacggtggaggagcgctaggatcaaaatcaaaagaagaacccttttgttggtatccattattggcagcataggctaaaggctttgtgtctttaacgcggccgc

SEQ ID NO: 283 - DNA, 1014 bp, Artificial Sequence
  HPfad3ABA'-2 amplicon
gcggccgcgttaaagacacaaagcctttagcctatgctgccaataatggataccaacaaaagggttcttcttttgattttgatcctagcgctcctccaccgtttaagattgcagaaatcagagcttcaataccaaaacattgctgggtcaagaatccatggagatccctcagttatgttctcagggatgtgcttgtaattgctgcattggtggctgcagcaattcacttcgacaactggcttctctggctaatctattgccccattcaaggcacaatgttctgggctctctttgttcttggacatgattgtggccatggaaggagatagataagcagagaaaacatggtagcccaacacagtgttgatattgctattccttttctctcactgggtgggaacagattgctgtagggattgaagtgagagccttcctttccggggcttcttgaaaacaaataaattggatacacaaacaatggaaatggcacagtgaatctaatgagtcttgtcatgctgtctagattcttgtaaatcttctctgttaatggaacccatgactcatccttctcaatgtgtccatggttttgatggtgagttctgtggctaattctccatccatggtatggcacaagaattgaggaatgcaagatgtgtcccaccaggctattcagcaaagggctatctgaaaagcttccatggccacaatcatgtccaagaacaaagagagcccagaacattgtgccttgaatggggcaatagattagccagagaagccagttgtcgaagtgaattgctgcagccaccaatgcagcaattacaagcacatccctgagaacataactgagggatctccatggattcttgacccagcaatgttttggtattgaagctctgatttctgcaatcttaaacggtggaggagcgctaggatcaaaatcaaaagaagaacccttttgttggtatccattattggcagcataggctaaaggctttgtgtctttaacgcggccgc

SEQ ID NO: 284 - DNA, 4526 bp, Artificial Sequence
  Plasmid pLF129
ttgtaatacgactcactatagggcgaattgggccctctagatgcatgctcgagcggccgccagtgtgatggatatctgcagaattcagggcggccgcgttaaagacacaaagcctttagcctatgctgccaataatggataccaacaaaagggttcttcttttgattttgatcctagcgctcctccaccgtttaagattgcagaaatcagagcttcaataccaaaacattgctgggtcaagaatccatggagatccctcagttatgttctcagggatgtgcttgtaattgctgcattggtggctgcagcaattcacttcgacaactggcttctctggctaatctattgccccattcaaggcacaatgttctgggctctctttgttcttggacatgattgtggccatggaaggagatagataagcagagaaaacatggtagcccaacacagtgttgatattgctattccttttctctcactgggtgggaacagattgctgtagggattgaagtgagagccttcctttccggggcttcttgaaaacaaataaattggatacacaaacaatggaaatggcacagtgaatctaatgagtcttgtcatgctgtctagattcttgtaaatcttctctgttaatggaacccatgactcatccttctcaatgtgtccatggttttgatggtgagttctgtggctaattctccatccatggtatggcacaagaattgaggaatgcaagatgtgtcccaccaggctattcagcaaagggctatctgaaaagcttccatggccacaatcatgtccaagaacaaagagagcccagaacattgtgccttgaatggggcaatagattagccagagaagccagttgtcgaagtgaattgctgcagccaccaatgcagcaattacaagcacatccctgagaacataactgagggatctccatggattcttgacccagcaatgttttggtattgaagctctgatttctgcaatcttaaacggtggaggagcgctaggatcaaaatcaaaagaagaacccttttgttggtatccattattggcagcataggctaaaggctttgtgtctttaacgcggccgccctgaattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaa

SEQ ID NO: 285 - DNA, 8503 bp, Artificial Sequence
  Plasmid pKR1189
ggccgcatgagccgtaaaggttcaatacaacgagtgcttgttttcttagggacaagcattgtacttatgtatgattctgtgtaaccatgagtcttccacgttgtactaatgtgaagggcaaaaataaaacacagaacaagttcgtttttctcaaataatgtgaaggtagaaaatggaaccatgcctcctctcttgcatgtgatttaaaatattagcagatggtaccgtacgtctagaggatccaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcagattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgactcgacgtacgatcccacatgcaagtttttatttcaatcccttttcctttgaataactgaccaagaacaacaagaaaaaaaaaaaaaaagaaaaggatcattttgaaaggatatttttcgctcctattcaaatactgtatttttaccaaaaaaactgtatttttcctacactctcaagctttgtttttcgcttcgactctcatgatttccttcatatgccaatcactctatttataaatggcataaggtagtgtgaacaattgcaaagcttgtcatcaaaagcttgcaatgtacaaattaatgtttttcatgcctttcaaaattatctgcaccccctagctattaatctaacatctaagtaaggctagtgaattttttcgaatagtcatgcagtgcattaatttccccgtgactattttggctttgactccaacactggccccgtacatccgtccctcattacatgaaaagaaatattgtttatattcttaattaaaaatattgtcccttctaaattttcatatagttaattattatattacttttttctctattctattagttctattttcaaattattatttatgcatatgtaaagtacattatatttttgctatatacttaaatatttctaaattattaaaaaaagactgatatgaaaaatttattctttttaaagctatatcattttatatatactttttcttttcttttctttcattttctattcaatttaataagaaataaattttgtaaatttttatttatcaatttataaaaatattttactttatatgttttttcacatttttgttaaacaaatcatatcattatgattgaaagagaggaaattgacagtgagtaataagtgatgagaaaaaaatgtgttatttcctaaaaaaaacctaaacaaacatgtatctactctctatttcatctatctctcatttcatttttctctttatctctttctttatttttttatcatatcatttcacattaattatttttactctctttattttttctctctatccctctcttatttccactcatatatacactccaaaattggggcatgcctttatcactactctatctcctccactaaatcatttaaatgaaactgaaaagcattggcaagtctcctcccctcctcaagtgatttccaactcagcattggcatctaattgattcagtatatctattgcatgtgtaaaagtctttccacaatacataactattaattaatcttaaataaataaaggataaaatatttttttttcttcataaaattaaaatatgttattttttgtttagatgtatattcgaataaatctaaatatatgataatgattttttatattgattaaacatataatcaatattaaatatgatatttttttatataggttgtacacataattttataaggataaaaaatatgataaaaataaattttaaatatttttatatttacgagaaaaaaaaatattttagccataaataaatgaccagcatattttacaaccttagtaattcataaattcctatatgtatatttgaaattaaaaacagataatcgttaagggaaggaatcctacgtcatctcttgccatttgtttttcatgcaaacagaaagggacgaaaaaccacctcaccatgaatcactcttcacaccatttttactagcaaacaagtctcaacaactgaagccagctctctttccgtttctttttacaacactttctttgaaatagtagtatttttttttcacatgatttattaacgtgccaaaagatgcttattgaatagagtgcacatttgtaatgtactactaattagaacatgaaaaagcattgttctaacacgataatcctgtgaaggcgttaactccaaagatccaatttcactatataaattgtgacgaaagcaaaatgaattcacatagctgagagagaaaggaaaggttaactaagaagcaatacttcagcggccgcgttaaagacacaaagcctttagcctatgctgccaataatggataccaacaaaagggttcttcttttgattttgatcctagcgctcctccaccgtttaagattgcagaaatcagagcttcaataccaaaacattgctgggtcaagaatccatggagatccctcagttatgttctcagggatgtgcttgtaattgctgcattggtggctgcagcaattcacttcgacaactggcttctctggctaatctattgccccattcaaggcacaatgttctgggctctctttgttcttggacatgattgtggccatggaagcttttcagatagccctttgctgaatagcctggtgggacacatcttgcattcctcaattcttgtgccataccatggatggagaattagccacagaactcaccatcaaaaccatggacacattgagaaggatgagtcatgggttccattaacagagaagatttacaagaatctagacagcatgacaagactcattagattcactgtgccatttccattgtttgtgtatccaatttatttgttttcaagaagccccggaaaggaaggctctcacttcaatccctacagcaatctgttcccacccagtgagagaaaaggaatagcaatatcaacactgtgttgggctaccatgttttctctgcttatctatctccttccatggccacaatcatgtccaagaacaaagagagcccagaacattgtgccttgaatggggcaatagattagccagagaagccagttgtcgaagtgaattgctgcagccaccaatgcagcaattacaagcacatccctgagaacataactgagggatctccatggattcttgacccagcaatgttttggtattgaagctctgatttctgcaatcttaaacggtggaggagcgctaggatcaaaatcaaaagaagaacccttttgttggtatccattattggcagcataggctaaaggctttgtgtctttaacgc

SEQ ID NO: 286 - DNA, 4112 bp, Artificial Sequence
  Plasmid pKR1209
agcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgcgttaaagacacaaagcctttagcctatgctgccaataatggataccaacaaaagggttcttcttttgattttgatcctagcgctcctccaccgtttaagattgcagaaatcagagcttcaataccaaaacattgctgggtcaagaatccatggagatccctcagttatgttctcagggatgtgcttgtaattgctgcattggtggctgcagcaattcacttcgacaactggcttctctggctaatctattgccccattcaaggcacaatgttctgggctctctttgttcttggacatgattgtggccatggaaggagatagataagcagagaaaacatggtagcccaacacagtgttgatattgctattccttttctctcactgggtgggaacagattgctgtagggattgaagtgagagccttcctttccggggcttcttgaaaacaaataaattggatacacaaacaatggaaatggcacagtgaatctaatgagtcttgtcatgctgtctagattcttgtaaatcttctctgttaatggaacccatgactcatccttctcaatgtgtccatggttttgatggtgagttctgtggctaattctccatccatggtatggcacaagaattgaggaatgcaagatgtgtcccaccaggctattcagcaaagggctatctgaaa

SEQ ID NO: 287 - DNA, 1143 bp, Glycine max
atggttcaagcacagcctctacaacatgttggtaatggtgcagggaaagaagatcaagcttattttgatccaagtgctccaccacccttcaagattgcaaatatcagagcagcaattccaaaacattgctgggagaagaacacattgagatctctgagttatgttctgagggatgtgttggtagtgactgcattggtagctgcagcaatcggcttcaatagctggttcttctggccactctattggcctgcacaaggcacaatgttttgggcactttttgttcttggacatgattgtggtcatggaagtttttcaaacagtcctttgttgaacagcattgtgggccacatcttgcactcttcaattcttgtaccataccatggatggagaattagccacaggactcaccatcagaaccatggccatgttgagaaggatgaatcatgggttccgcttacagagaaagtttacaagaatctagacaacatgacaagaatgatgagattcactcttcctttccccatctttgcataccccttttatttgtggagcagaagccctggaaaagaaggctctcatttcaacccttacagcaacttgttctctcctggtgagagaagagatgtgctaacttcaactctgtgttggggcatcatgctttctgtgcttctctatctttccctcacaatgggtccactttttatgctcaagctctatggggttccctatttgatcttcgtcatgtggctggatttcgtcacgtacttgcatcatcatggttacaagcagaaactgccttggtaccgtggccaggaatggagttatctaaggggtggtcttacaacagtagatcgcgactatggttggatcaacaacattcaccatgacattggcacccatgttatccatcaccttttccctcaaattccacattatcatttaatcgaagcgactaaagcagcaaaggcagtgctaggaaagtattatcgtgagcctcagaaatctgggccattgccacttcatctaataaagtacttgctccacagcataagtcaggatcacttcgttagcgactctggcgacattgtgtactaccagactgattcccagctccacaaagattcttggacccagtccaactaa

SEQ ID NO: 288 - protein, 380 aa, Glycine max
MVQAQPLQHVGNGAGKEDQAYFDPSAPPPFKIANIRAAIPKHCWEKNTLRSLSYVLRDVLVVTALVAAAIGFNSWFFWPLYWPAQGTMFWALFVLGHDCGHGSFSNSPLLNSIVGHILHSSILVPYHGWRISHRTHHQNHGHVEKDESWVPLTEKVYKNLDNMTRMMRFTLPFPIFAYPFYLWSRSPGKEGSHFNPYSNLFSPGERRDVLTSTLCWGIMLSVLLYLSLTMGPLFMLKLYGVPYLIFVMWLDFVTYLHHHGYKQKLPWYRGQEWSYLRGGLTTVDRDYGWINNIHHDIGTHVIHHLFPQIPHYHLIEATKAAKAVLGKYYREPQKSGPLPLHLIKYLLHSISQDHFVSDSGDIVYYQTDSQLHKDSWTQSN

SEQ ID NO: 289 - DNA, 40 bp, Artificial Sequence
  fad3c-5 primer
ctcgagaagcggccgcattgatccaagtgctccaccaccc

SEQ ID NO: 290 - DNA, 28 bp, Artificial Sequence
  fad3c-3 primer
gatatctatgtccaagaacaaaaagtgc

SEQ ID NO: 291 - DNA, 3764 bp, Artificial Sequence
  Plasmid pKR1213
aattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaagcccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgtatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgccagtgtgatggatatctgcagaattcagggatatctatgtccaagaacaaaaagtgcccaaaacattgtgccttgtgcaggccaatagagtggccagaagaaccagctattgaagccgattgctgcagctaccaatgcagtcactaccaacacatccctcagaacataactcagagatctcaatgtgttcttctcccagcaatgttttggaattgctgctctgatatttgcaatcttgaagggtggtggagcacttggatcaatgcggccgcttctcgagcctg

SEQ ID NO: 292 - DNA, 4353 bp, Artificial Sequence
  Plasmid pKR1218
ggccgcgttaaagacacaaagcctttagcctatgctgccaataatggataccaacaaaagggttcttcttttgattttgatcctagcgctcctccaccgtttaagattgcagaaatcagagcttcaataccaaaacattgctgggtcaagaatccatggagatccctcagttatgttctcagggatgtgcttgtaattgctgcattggtggctgcagcaattcacttcgacaactggcttctctggctaatctattgccccattcaaggcacaatgttctgggctctctttgttcttggacatgattgtggccatggaaggagatagataagcagagaaaacatggtagcccaacacagtgttgatattgctattccttttctctcactgggtgggaacagattgctgtagggattgaagtgagagccttcctttccggggcttcttgaaaacaaataaattggatacacaaacaatggaaatggcacagtgaatctaatgagtcttgtcatgctgtctagattcttgtaaatcttctctgttaatggaacccatgactcatccttctcaatgtgtccatggttttgatggtgagttctgtggctaattctccatccatggtatggcacaagaattgaggaatgcaagatgtgtcccaccaggctattcagcaaagggctatctgaaaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagaagcggccgcattgatccaagtgctccaccacccttcaagattgcaaatatcagagcagcaattccaaaacattgctgggagaagaacacattgagatctctgagttatgttctgagggatgtgttggtagtgactgcattggtagctgcagcaatcggcttcaatagctggttcttctggccactctattggcctgcacaaggcacaatgttttgggcactttttgttcttggacatagat

SEQ ID NO: 293 - DNA, 3742 bp, Artificial Sequence
  Plasmid pKR1210
agcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgcgttaaagacacaaagcctttagcctatgctgccaataatggataccaacaaaagggttcttcttttgattttgatcctagcgctcctccaccgtttaagattgcagaaatcagagcttcaataccaaaacattgctgggtcaagaatccatggagatccctcagttatgttctcagggatgtgcttgtaattgctgcattggtggctgcagcaattcacttcgacaactggcttctctggctaatctattgccccattcaaggcacaatgttctgggctctctttgttcttggacatgattgtggccatgga

SEQ ID NO: 294 - DNA, 3983 bp, Artificial Sequence
  Plasmid pKR1219
ggccgcgttaaagacacaaagcctttagcctatgctgccaataatggataccaacaaaagggttcttcttttgattttgatcctagcgctcctccaccgtttaagattgcagaaatcagagcttcaataccaaaacattgctgggtcaagaatccatggagatccctcagttatgttctcagggatgtgcttgtaattgctgcattggtggctgcagcaattcacttcgacaactggcttctctggctaatctattgccccattcaaggcacaatgttctgggctctctttgttcttggacatgattgtggccatggaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagaagcggccgcattgatccaagtgctccaccacccttcaagattgcaaatatcagagcagcaattccaaaacattgctgggagaagaacacattgagatctctgagttatgttctgagggatgtgttggtagtgactgcattggtagctgcagcaatcggcttcaatagctggttcttctggccactctattggcctgcacaaggcacaatgttttgggcactttttgttcttggacatagat

SEQ ID NO: 295 - DNA, 4894 bp, Artificial Sequence
  Plasmid pKR1225
cgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagaagcggccgcattgatccaagtgctccaccacccttcaagattgcaaatatcagagcagcaattccaaaacattgctgggagaagaacacattgagatctctgagttatgttctgagggatgtgttggtagtgactgcattggtagctgcagcaatcggcttcaatagctggttcttctggccactctattggcctgcacaaggcacaatgttttgggcactttttgttcttggacatagatggccgcgttaaagacacaaagcctttagcctatgctgccaataatggataccaacaaaagggttcttcttttgattttgatcctagcgctcctccaccgtttaagattgcagaaatcagagcttcaataccaaaacattgctgggtcaagaatccatggagatccctcagttatgttctcagggatgtgcttgtaattgctgcattggtggctgcagcaattcacttcgacaactggcttctctggctaatctattgccccattcaaggcacaatgttctgggctctctttgttcttggacatgattgtggccatggaagcttttcagatagccctttgctgaatagcctggtgggacacatcttgcattcctcaattcttgtgccataccatggatggagaattagccacagaactcaccatcaaaaccatggacacattgagaaggatgagtcatgggttccattaacagagaagatttacaagaatctagacagcatgacaagactcattagattcactgtgccatttccattgtttgtgtatccaatttatttgttttcaagaagccccggaaaggaaggctctcacttcaatccctacagcaatctgttcccacccagtgagagaaaaggaatagcaatatcaacactgtgttgggctaccatgttttctctgcttatctatctccttccatggccacaatcatgtccaagaacaaagagagcccagaacattgtgccttgaatggggcaatagattagccagagaagccagttgtcgaagtgaattgctgcagccaccaatgcagcaattacaagcacatccctgagaacataactgagggatctccatggattcttgacccagcaatgttttggtattgaagctctgatttctgcaatcttaaacggtggaggagcgctaggatcaaaatcaaaagaagaacccttttgttggtatccattattggcagcataggctaaaggctttgtgtctttaacgcggccatctatgtccaagaacaaaaagtgcccaaaacattgtgccttgtgcaggccaatagagtggccagaagaaccagctattgaagccgattgctgcagctaccaatgcagtcactaccaacacatccctcagaacataactcagagatctcaatgtgttcttctcccagcaatgttttggaattgctgctctgatatttgcaatcttgaagggtggtggagcacttggatcaatgcggccgcttctcga

SEQ ID NO: 296 - DNA, 8979 bp, Artificial Sequence
  Plasmid pKR1229
ggccgcatgagccgtaaaggttcaatacaacgagtgcttgttttcttagggacaagcattgtacttatgtatgattctgtgtaaccatgagtcttccacgttgtactaatgtgaagggcaaaaataaaacacagaacaagttcgtttttctcaaataatgtgaaggtagaaaatggaaccatgcctcctctcttgcatgtgatttaaaatattagcagatggtaccgtacgtctagaggatccaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcagattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgactcgacgtacgatcccacatgcaagtttttatttcaatcccttttcctttgaataactgaccaagaacaacaagaaaaaaaaaaaaaaagaaaaggatcattttgaaaggatatttttcgctcctattcaaatactgtatttttaccaaaaaaactgtatttttcctacactctcaagctttgtttttcgcttcgactctcatgatttccttcatatgccaatcactctatttataaatggcataaggtagtgtgaacaattgcaaagcttgtcatcaaaagcttgcaatgtacaaattaatgtttttcatgcctttcaaaattatctgcaccccctagctattaatctaacatctaagtaaggctagtgaattttttcgaatagtcatgcagtgcattaatttccccgtgactattttggctttgactccaacactggccccgtacatccgtccctcattacatgaaaagaaatattgtttatattcttaattaaaaatattgtcccttctaaattttcatatagttaattattatattacttttttctctattctattagttctattttcaaattattatttatgcatatgtaaagtacattatatttttgctatatacttaaatatttctaaattattaaaaaaagactgatatgaaaaatttattctttttaaagctatatcattttatatatactttttcttttcttttctttcattttctattcaatttaataagaaataaattttgtaaatttttatttatcaatttataaaaatattttactttatatgttttttcacatttttgttaaacaaatcatatcattatgattgaaagagaggaaattgacagtgagtaataagtgatgagaaaaaaatgtgttatttcctaaaaaaaacctaaacaaacatgtatctactctctatttcatctatctctcatttcatttttctctttatctctttctttatttttttatcatatcatttcacattaattatttttactctctttattttttctctctatccctctcttatttccactcatatatacactccaaaattggggcatgcctttatcactactctatctcctccactaaatcatttaaatgaaactgaaaagcattggcaagtctcctcccctcctcaagtgatttccaactcagcattggcatctaattgattcagtatatctattgcatgtgtaaaagtctttccacaatacataactattaattaatcttaaataaataaaggataaaatatttttttttcttcataaaattaaaatatgttattttttgtttagatgtatattcgaataaatctaaatatatgataatgattttttatattgattaaacatataatcaatattaaatatgatatttttttatataggttgtacacataattttataaggataaaaaatatgataaaaataaattttaaatatttttatatttacgagaaaaaaaaatattttagccataaataaatgaccagcatattttacaaccttagtaattcataaattcctatatgtatatttgaaattaaaaacagataatcgttaagggaaggaatcctacgtcatctcttgccatttgtttttcatgcaaacagaaagggacgaaaaaccacctcaccatgaatcactcttcacaccatttttactagcaaacaagtctcaacaactgaagccagctctctttccgtttctttttacaacactttctttgaaatagtagtatttttttttcacatgatttattaacgtgccaaaagatgcttattgaatagagtgcacatttgtaatgtactactaattagaacatgaaaaagcattgttctaacacgataatcctgtgaaggcgttaactccaaagatccaatttcactatataaattgtgacgaaagcaaaatgaattcacatagctgagagagaaaggaaaggttaactaagaagcaatacttcagcggccgcattgatccaagtgctccaccacccttcaagattgcaaatatcagagcagcaattccaaaacattgctgggagaagaacacattgagatctctgagttatgttctgagggatgtgttggtagtgactgcattggtagctgcagcaatcggcttcaatagctggttcttctggccactctattggcctgcacaaggcacaatgttttgggcactttttgttcttggacatagatggccgcgttaaagacacaaagcctttagcctatgctgccaataatggataccaacaaaagggttcttcttttgattttgatcctagcgctcctccaccgtttaagattgcagaaatcagagcttcaataccaaaacattgctgggtcaagaatccatggagatccctcagttatgttctcagggatgtgcttgtaattgctgcattggtggctgcagcaattcacttcgacaactggcttctctggctaatctattgccccattcaaggcacaatgttctgggctctctttgttcttggacatgattgtggccatggaagcttttcagatagccctttgctgaatagcctggtgggacacatcttgcattcctcaattcttgtgccataccatggatggagaattagccacagaactcaccatcaaaaccatggacacattgagaaggatgagtcatgggttccattaacagagaagatttacaagaatctagacagcatgacaagactcattagattcactgtgccatttccattgtttgtgtatccaatttatttgttttcaagaagccccggaaaggaaggctctcacttcaatccctacagcaatctgttcccacccagtgagagaaaaggaatagcaatatcaacactgtgttgggctaccatgttttctctgcttatctatctccttccatggccacaatcatgtccaagaacaaagagagcccagaacattgtgccttgaatggggcaatagattagccagagaagccagttgtcgaagtgaattgctgcagccaccaatgcagcaattacaagcacatccctgagaacataactgagggatctccatggattcttgacccagcaatgttttggtattgaagctctgatttctgcaatcttaaacggtggaggagcgctaggatcaaaatcaaaagaagaacccttttgttggtatccattattggcagcataggctaaaggctttgtgtctttaacgcggccatctatgtccaagaacaaaaagtgcccaaaacattgtgccttgtgcaggccaatagagtggccagaagaaccagctattgaagccgattgctgcagctaccaatgcagtcactaccaacacatccctcagaacataactcagagatctcaatgtgttcttctcccagcaatgttttggaattgctgctctgatatttgcaatcttgaagggtggtggagcacttggatcaatgc

SEQ ID NO: 297 - DNA, 10221 bp, Artificial Sequence
  Plasmid pKR1249
gtacgtctagaggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagctgggtctagaactagaaacgtgatgccacttgttattgaagtcgattacagcatctattctgttttactatttataactttgccatttctgacttttgaaaactatctctggatttcggtatcgctttgtgaagatcgagcaaaagagacgttttgtggacgcaatggtccaaatccgttctacatgaacaaattggtcacaatttccactaaaagtaaataaatggcaagttaaaaaaggaatatgcattttactgattgcctaggtgagctccaagagaagttgaatctacacgtctaccaaccgctaaaaaaagaaaaacattgaatatgtaacctgattccattagcttttgacttcttcaacagattctctacttagatttctaacagaaatattattactagcacatcattttcagtctcactacagcaaaaaatccaacggcacaatacagacaacaggagatatcagactacagagatagatagatgctactgcatgtagtaagttaaataaaaggaaaataaaatgtcttgctaccaaaactactacagactatgatgctcaccacaggccaaatcctgcaactaggacagcattatcttatatatattgtacaaaacaagcatcaaggaacatttggtctaggcaatcagtacctcgttctaccatcaccctcagttatcacatccttgaaggatccattactgggaatcatcggcaacacatgctcctgatggggcacaatgacatcaagaaggtaggggccaggggtgtccaacattctctgaattgccgctctaagctcttccttcttcgtcactcgcgctgccggtatcccacaagcatcagcaaacttgagcatgtttgggaatatctcgctctcgctagacggatctccaagataggtgtgagctctattggacttgtagaacctatcctccaactgaaccaccatacccaaatgctgattgttcaacaacaatatcttaactgggagattctccactcttatagtggccaactcctgaacattcatgatgaaactaccatccccatcaatgtcaaccacaacagccccagggttagcaacagcagcaccaatagccgcaggcaatccaaaacccatggctccaagaccccctgaggtcaaccactgcctcggtctcttgtacttgtaaaactgcgcagcccacatttgatgctgcccaaccccagtactaacaatagcatctccattagtcaactcatcaagaacctcgatagcatgctgcggagaaatcgcgtcctggaatgtcttgtaacccaatggaaacttgtgtttctgcacattaatctcttctctccaacctccaagatcaaacttaccctccactcctttctcctccaaaatcatattaattcccttcaaggccaacttcaaatccgcgcaaaccgacacgtgcgcctgcttgttcttcccaatctcggcagaatcaatatcaatgtgaacaatcttagccctactagcaaaagcctcaagcttcccagtaacacggtcatcaaaccttaccccaaaggcaagcaacaaatcactattgtcaacagcatagttagcataaacagtaccatgcatacccagcatctgaagggaatattcatcaccaataggaaaagttccaagacccattaaagtgctagcaacgggaataccagtgagttcaacaaagcgcctcaattcagcactggaattcaaactgccaccgccgacgtagagaacgggcttttgggcctccatgatgagtctgacaatgtgttccaattgggcctcggcggggggcctgggcagcctggcgaggtaaccggggaggttaacgggctcgtcccaattaggcacggcgagttgctgctgaacgtctttgggaatgtcgatgaggaccggaccggggcggccggaggtggcgacgaagaaagcctcggcgacgacgcgggggatgtcgtcgacgtcgaggatgaggtagttgtgcttcgtgatggatctgctcacctccacgatcggggtttcttggaaggcgtcggtgccgatcatccggcgggcgacctggccggtgatggcgacgactgggacgctgtccattaaagcgtcggcgaggccgctcacgaggttggtggcgccggggccggaggtggcaatgcagacgccggggaggccggaggaacgcgcgtagccttcggcggcgaagacgccgccctgctcgtggcgcgggagcacgttgcggatggcggcggagcgcgtgagcgcctggtggatctccatcgacgcaccgccggggtacgcgaacaccgtcgtcacgccctgcctctccagcgcctccacaaggatgtccgcgcccttgcgaggttcgccggaggcgaaccgtgacacgaagggctccgtggtcggcgcttccttggtgaagggcgccgccgtggggggtttggagatggaacatttgattttgagagcgtggttgggtttggtgagggtttgatgagagagagggagggtggatctagtaatgcgtttggggaaggtggggtgtgaagaggaagaagagaatcgggtggttctggaagcggtggccgccattgtgttgtgtggcatggttatacttcaaaaactgcacaacaagcctagagttagtacctaaacagtaaatttacaacagagagcaaagacacatgcaaaaatttcagccataaaaaaagttataatagaatttaaagcaaaagtttcattttttaaacatatatacaaacaaactggatttgaaggaagggattaattcccctgctcaaagtttgaattcctattgtgacctatactcgaataaaattgaagcctaaggaatgtatgagaaacaagaaaacaaaacaaaactacagacaaacaagtacaattacaaaattcgctaaaattctgtaatcaccaaaccccatctcagtcagcacaaggcccaaggtttattttgaaataaaaaaaaagtgattttatttctcataagctaaaagaaagaaaggcaattatgaaatgatttcgactagatctgaaagtcaaacgcgtattccgcagatattaaagaaagagtagagtttcacatggatcctagatggacccagttgaggaaaaagcaaggcaaagcaaaccagaagtgcaagatccgaaattgaaccacggaatctaggatttggtagagggagaagaaaagtaccttgagaggtagaagagaagagaagagcagagagatatatgaacgagtgtgtcttggtctcaactctgaagcgatacgagtttagaggggagcattgagttccaatttatagggaaaccgggtggcaggggtgagttaatgacggaaaagcccctaagtaacgagattggattgtgggttagattcaaccgtttgcatccgcggcttagattggggaagtcagagtgaatctcaaccgttgactgagttgaaaattgaatgtagcaaccaattgagccaaccccagcctttgccctttgattttgatttgtttgttgcatactttttatttgtcttctggttctgactctctttctctcgtttcaatgccaggttgcctactcccacaccactcacaagaagattctactgttagtattaaatattttttaatgtattaaatgatgaatgcttttgtaaacagaacaagactatgtctaataagtgtcttgcaacattttttaagaaattaaaaaaaatatatttattatcaaaatcaaatgtatgaaaaatcatgaataatataattttatacatttttttaaaaaatcttttaatttcttaattaatatcttaaaaataatgattaatatttaacccaaaataattagtatgattggtaaggaagatatccatgttatgtttggatgtgagtttgatctagagcaaagcttactagagtcgacctgcaggtcgactcgacgtacgatcccacatgcaagtttttatttcaatcccttttcctttgaataactgaccaagaacaacaagaaaaaaaaaaaaaaagaaaaggatcattttgaaaggatatttttcgctcctattcaaatactgtatttttaccaaaaaaactgtatttttcctacactctcaagctttgtttttcgcttcgactctcatgatttccttcatatgccaatcactctatttataaatggcataaggtagtgtgaacaattgcaaagcttgtcatcaaaagcttgcaatgtacaaattaatgtttttcatgcctttcaaaattatctgcaccccctagctattaatctaacatctaagtaaggctagtgaattttttcgaatagtcatgcagtgcattaatttccccgtgactattttggctttgactccaacactggccccgtacatccgtccctcattacatgaaaagaaatattgtttatattcttaattaaaaatattgtcccttctaaattttcatatagttaattattatattacttttttctctattctattagttctattttcaaattattatttatgcatatgtaaagtacattatatttttgctatatacttaaatatttctaaattattaaaaaaagactgatatgaaaaatttattctttttaaagctatatcattttatatatactttttcttttcttttctttcattttctattcaatttaataagaaataaattttgtaaatttttatttatcaatttataaaaatattttactttatatgttttttcacatttttgttaaacaaatcatatcattatgattgaaagagaggaaattgacagtgagtaataagtgatgagaaaaaaatgtgttatttcctaaaaaaaacctaaacaaacatgtatctactctctatttcatctatctctcatttcatttttctctttatctctttctttatttttttatcatatcatttcacattaattatttttactctctttattttttctctctatccctctcttatttccactcatatatacactccaaaattggggcatgcctttatcactactctatctcctccactaaatcatttaaatgaaactgaaaagcattggcaagtctcctcccctcctcaagtgatttccaactcagcattggcatctaattgattcagtatatctattgcatgtgtaaaagtctttccacaatacataactattaattaatcttaaataaataaaggataaaatatttttttttcttcataaaattaaaatatgttattttttgtttagatgtatattcgaataaatctaaatatatgataatgattttttatattgattaaacatataatcaatattaaatatgatatttttttatataggttgtacacataattttataaggataaaaaatatgataaaaataaattttaaatatttttatatttacgagaaaaaaaaatattttagccataaataaatgaccagcatattttacaaccttagtaattcataaattcctatatgtatatttgaaattaaaaacagataatcgttaagggaaggaatcctacgtcatctcttgccatttgtttttcatgcaaacagaaagggacgaaaaaccacctcaccatgaatcactcttcacaccatttttactagcaaacaagtctcaacaactgaagccagctctctttccgtttctttttacaacactttctttgaaatagtagtatttttttttcacatgatttattaacgtgccaaaagatgcttattgaatagagtgcacatttgtaatgtactactaattagaacatgaaaaagcattgttctaacacgataatcctgtgaaggcgttaactccaaagatccaatttcactatataaattgtgacgaaagcaaaatgaattcacatagctgagagagaaaggaaaggttaactaagaagcaatacttcagcggccgcattgatccaagtgctccaccacccttcaagattgcaaatatcagagcagcaattccaaaacattgctgggagaagaacacattgagatctctgagttatgttctgagggatgtgttggtagtgactgcattggtagctgcagcaatcggcttcaatagctggttcttctggccactctattggcctgcacaaggcacaatgttttgggcactttttgttcttggacatagatggccgcgttaaagacacaaagcctttagcctatgctgccaataatggataccaacaaaagggttcttcttttgattttgatcctagcgctcctccaccgtttaagattgcagaaatcagagcttcaataccaaaacattgctgggtcaagaatccatggagatccctcagttatgttctcagggatgtgcttgtaattgctgcattggtggctgcagcaattcacttcgacaactggcttctctggctaatctattgccccattcaaggcacaatgttctgggctctctttgttcttggacatgattgtggccatggaagcttttcagatagccctttgctgaatagcctggtgggacacatcttgcattcctcaattcttgtgccataccatggatggagaattagccacagaactcaccatcaaaaccatggacacattgagaaggatgagtcatgggttccattaacagagaagatttacaagaatctagacagcatgacaagactcattagattcactgtgccatttccattgtttgtgtatccaatttatttgttttcaagaagccccggaaaggaaggctctcacttcaatccctacagcaatctgttcccacccagtgagagaaaaggaatagcaatatcaacactgtgttgggctaccatgttttctctgcttatctatctccttccatggccacaatcatgtccaagaacaaagagagcccagaacattgtgccttgaatggggcaatagattagccagagaagccagttgtcgaagtgaattgctgcagccaccaatgcagcaattacaagcacatccctgagaacataactgagggatctccatggattcttgacccagcaatgttttggtattgaagctctgatttctgcaatcttaaacggtggaggagcgctaggatcaaaatcaaaagaagaacccttttgttggtatccattattggcagcataggctaaaggctttgtgtctttaacgcggccatctatgtccaagaacaaaaagtgcccaaaacattgtgccttgtgcaggccaatagagtggccagaagaaccagctattgaagccgattgctgcagctaccaatgcagtcactaccaacacatccctcagaacataactcagagatctcaatgtgttcttctcccagcaatgttttggaattgctgctctgatatttgcaatcttgaagggtggtggagcacttggatcaatgcggccgcatgagccgtaaaggttcaatacaacgagtgcttgttttcttagggacaagcattgtacttatgtatgattctgtgtaaccatgagtcttccacgttgtactaatgtgaagggcaaaaataaaacacagaacaagttcgtttttctcaaataatgtgaaggtagaaaatggaaccatgcctcctctcttgcatgtgatttaaaatattagcagatggtacc

SEQ ID NO: 298 - DNA, 33 bp, Artificial Sequence
  oEAd9el1-1 primer
agcggccgcaccatggaagcagccaaagaattg

SEQ ID NO: 299 - DNA, 28 bp, Artificial Sequence
  oLINK-1 primer
tcggccggacactgccagggagtcgtag

SEQ ID NO: 300 - DNA, 4362 bp, Artificial Sequence
  Plasmid pKR1298
aattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaagcccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgtatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgccagtgtgatggatatctgcagaattcaggagcggccgcaccatggaagcagccaaagaattggtttccatcgtccaagaggagctccccaaggtggactatgcccagctttggcaggatgccagcagctgtgaggtcctttacctctcggtggcattcgtggcgatcaagttcatgctgcgcccactggacctgaagcgccaggccaccttgaagaagctgttcacagcatacaacttcctcatgtcgatctattcctttggctccttcctggccatggcctatgccctatcagtaactggcatcctctccggcgactgtgagacggcgttcaacaacgatgtgttcaggatcacaactcagctgttctacctcagcaagttcgtagagtacatcgactccttctaccttccccttatggacaagccactgtcgttccttcagttcttccatcatttgggggcccccattgacatgtggctattctacaaataccgcaacgaaggagtctggatctttgtcctgttgaatgggttcattcactggatcatgtacggttactattggacgcggctcatcaagctgaacttccccatgcccaagaacctgatcacctccatgcagatcatccagttcaatgtcgggttctacatcgtctggaagtaccgcaatgtgccatgctaccgccaggatgggatgcgcatgtttgcctggatcttcaactactggtatgtcgggacggtcttgctgctgttcctcaacttttacgtgcagacgtacatccggaagccgaggaagaaccgagggaagaaggagcccgcccgtccagctggactcccgccggccacgtactacgactccctggcagtgtccggccgacctg

SEQ ID NO: 301 - DNA, 21 bp, Artificial Sequence
  oTPd8-1 primer
cgcggccgcaccatgtctcct

SEQ ID NO: 302 - DNA, 28 bp, Artificial Sequence
  oTPd8fus-1 primer
gacgggcgggttcagggacagcagccag

SEQ ID NO: 303 - DNA, 17 bp, Artificial Sequence
  oLINK-2 primer
cccgcccgtccagctgg

SEQ ID NO: 304 - DNA, 28 bp, Artificial Sequence
  oLINK-1 primer
tcggccggacactgccagggagtcgtag

SEQ ID NO: 305 - DNA, 1335 bp, Artificial Sequence
  TpomD8-EgDHAsyn1Link
cgcggccgcaccatgtctcctaagcggcaagctctgccaatcacaattgatggcgcaacttatgatgtgtctgcttgggtcaatcaccaccctggaggagctgacattatcgagaactatcgcaaccgcgatgcgaccgatgtcttcatggtgatgcactctcaagaagccgtcgccaagttgaagagaatgcctgttatggagccttcctctcctgacacacctgttgcacccaagcctaagcgtgatgagccccaggaggatttccgcaagttgcgggaggaattcatctccaagggtatgttcgagacgagtttcctttggtatttttacaagacttcaactaccgtcggtttgatggtcctttccatcttgatgaccgtgtacacgaattggtatttcaccgctgctttggttcttggcgtgtgctaccaacagctaggctggttgtcccacgactattgccatcaccaggttttcacaaaccgcaagattaacgacgctttcggtctctttttcggtaacgtgatgcagggatactcacagacttggtggaaggataggcacaatggtcaccatgccgccaccaatgtggtcggccatgacccagatattgataacctccccatcctggcttggtctcccgaagatgtcaagagggctactccttcgactcggaatctcatcaagtaccagcagtactacttcattcccaccattgcatcccttaggttcatctggtgcctccaatccatcggcggcgtcatgtcctacaagagcgaggagaggaacctgtactacaagcgccagtacactaaggaggcgattggtctggccctccactgggtgctcaaggccactttctattgcagtgccatgcctagctttgccaccggtttgggatgcttcttgatctccgagctgctcggaggatttggcattgccatcgttgtgtttctgaatcactatcctttggacaaggttgaggagactgtctgggatgagcacgggttcagcgccagccagatccacgagacgttgaacattaagcccggccttctcaccgattgggtctttggtggtctcaactaccagattgagcaccacttgtggcccaacatgcccaggcacaacctcacggcagcttccctggaggtgcagaagttgtgcgccaagcacaacctgccctacagggccccagccatcatccccggggttcagaaattggtcagcttcttaggcgagattgcccagctggctgctgtccctgaacccgcccgtccagctggactcccgccggccacgtactacgactccctggcagtgtccggccga

SEQ ID NO: 306 - DNA, 4848 bp, Artificial Sequence
  Plasmid pKR1291
aattcaggcgcggccgcaccatgtctcctaagcggcaagctctgccaatcacaattgatggcgcaacttatgatgtgtctgcttgggtcaatcaccaccctggaggagctgacattatcgagaactatcgcaaccgcgatgcgaccgatgtcttcatggtgatgcactctcaagaagccgtcgccaagttgaagagaatgcctgttatggagccttcctctcctgacacacctgttgcacccaagcctaagcgtgatgagccccaggaggatttccgcaagttgcgggaggaattcatctccaagggtatgttcgagacgagtttcctttggtatttttacaagacttcaactaccgtcggtttgatggtcctttccatcttgatgaccgtgtacacgaattggtatttcaccgctgctttggttcttggcgtgtgctaccaacagctaggctggttgtcccacgactattgccatcaccaggttttcacaaaccgcaagattaacgacgctttcggtctctttttcggtaacgtgatgcagggatactcacagacttggtggaaggataggcacaatggtcaccatgccgccaccaatgtggtcggccatgacccagatattgataacctccccatcctggcttggtctcccgaagatgtcaagagggctactccttcgactcggaatctcatcaagtaccagcagtactacttcattcccaccattgcatcccttaggttcatctggtgcctccaatccatcggcggcgtcatgtcctacaagagcgaggagaggaacctgtactacaagcgccagtacactaaggaggcgattggtctggccctccactgggtgctcaaggccactttctattgcagtgccatgcctagctttgccaccggtttgggatgcttcttgatctccgagctgctcggaggatttggcattgccatcgttgtgtttctgaatcactatcctttggacaaggttgaggagactgtctgggatgagcacgggttcagcgccagccagatccacgagacgttgaacattaagcccggccttctcaccgattgggtctttggtggtctcaactaccagattgagcaccacttgtggcccaacatgcccaggcacaacctcacggcagcttccctggaggtgcagaagttgtgcgccaagcacaacctgccctacagggccccagccatcatccccggggttcagaaattggtcagcttcttaggcgagattgcccagctggctgctgtccctgaacccgcccgtccagctggactcccgccggccacgtactacgactccctggcagtgtccggccgacctgaattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaagcccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgtatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgccagtgtgatggatatctgcag

SEQ ID NO: 307 - DNA, 4284 bp, Artificial Sequence
  Plasmid pKR1301
ggccgcaccatgtctcctaagcggcaagctctgccaatcacaattgatggcgcaacttatgatgtgtctgcttgggtcaatcaccaccctggaggagctgacattatcgagaactatcgcaaccgcgatgcgaccgatgtcttcatggtgatgcactctcaagaagccgtcgccaagttgaagagaatgcctgttatggagccttcctctcctgacacacctgttgcacccaagcctaagcgtgatgagccccaggaggatttccgcaagttgcgggaggaattcatctccaagggtatgttcgagacgagtttcctttggtatttttacaagacttcaactaccgtcggtttgatggtcctttccatcttgatgaccgtgtacacgaattggtatttcaccgctgctttggttcttggcgtgtgctaccaacagctaggctggttgtcccacgactattgccatcaccaggttttcacaaaccgcaagattaacgacgctttcggtctctttttcggtaacgtgatgcagggatactcacagacttggtggaaggataggcacaatggtcaccatgccgccaccaatgtggtcggccatgacccagatattgataacctccccatcctggcttggtctcccgaagatgtcaagagggctactccttcgactcggaatctcatcaagtaccagcagtactacttcattcccaccattgcatcccttaggttcatctggtgcctccaatccatcggcggcgtcatgtcctacaagagcgaggagaggaacctgtactacaagcgccagtacactaaggaggcgattggtctggccctccactgggtgctcaaggccactttctattgcagtgccatgcctagctttgccaccggtttgggatgcttcttgatctccgagctgctcggaggatttggcattgccatcgttgtgtttctgaatcactatcctttggacaaggttgaggagactgtctgggatgagcacgggttcagcgccagccagatccacgagacgttgaacattaagcccggccttctcaccgattgggtctttggtggtctcaactaccagattgagcaccacttgtggcccaacatgcccaggcacaacctcacggcagcttccctggaggtgcagaagttgtgcgccaagcacaacctgccctacagggccccagccatcatccccggggttcagaaattggtcagcttcttaggcgagattgcccagctggctgctgtccctgaacccgcccgtccagctggactcccgccggccacgtactacgactccctggcagtgtccggccgccaccgcggtggagctccagcttttgttccctttagtgagggttaatttcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgacggtatcgataagcttgatatcgaattcctgcagcccgggggatccactagttctagagc

SEQ ID NO: 308 - DNA, 4284 bp, Artificial Sequence
  Plasmid pKR1301R
ggccgcaccatgtctcctaagcggcaagctctgccaatcacaattgatggcgcaacttatgatgtgtctgcttgggtcaatcaccaccctggaggagctgacattatcgagaactatcgcaaccgcgatgcgaccgatgtcttcatggtgatgcactctcaagaagccgtcgccaagttgaagagaatgcctgttatggagccttcctctcctgacacacctgttgcacccaagcctaagcgtgatgagccccaggaggatttccgcaagttgcgggaggaattcatctccaagggtatgttcgagacgagtttcctttggtatttttacaagacttcaactaccgtcggtttgatggtcctttccatcttgatgaccgtgtacacgaattggtatttcaccgctgctttggttcttggcgtgtgctaccaacagctaggctggttgtcccacgactattgccatcaccaggttttcacaaaccgcaagattaacgacgctttcggtctctttttcggtaacgtgatgcagggatactcacagacttggtggaaggataggcacaatggtcaccatgccgccaccaatgtggtcggccatgacccagatattgataacctccccatcctggcttggtctcccgaagatgtcaagagggctactccttcgactcggaatctcatcaagtaccagcagtactacttcattcccaccattgcatcccttaggttcatctggtgcctccaatccatcggcggcgtcatgtcctacaagagcgaggagaggaacctgtactacaagcgccagtacactaaggaggcgattggtctggccctccactgggtgctcaaggccactttctattgcagtgccatgcctagctttgccaccggtttgggatgcttcttgatctccgagctgctcggaggatttggcattgccatcgttgtgtttctgaatcactatcctttggacaaggttgaggagactgtctgggatgagcacgggttcagcgccagccagatccacgagacgttgaacattaagcccggccttctcaccgattgggtctttggtggtctcaactaccagattgagcaccacttgtggcccaacatgcccaggcacaacctcacggcagcttccctggaggtgcagaagttgtgcgccaagcacaacctgccctacagggccccagccatcatccccggggttcagaaattggtcagcttcttaggcgagattgcccagctggctgctgtccctgaacccgcccgtccagctggactcccgccggccacgtactacgactccctggcagtgtccggccgctctagaactagtggatcccccgggctgcaggaattcgatatcaagcttatcgataccgtcgacctcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctcgaaattaaccctcactaaagggaacaaaagctggagctccaccgcggtggc

SEQ ID NO: 309 - DNA, 4228 bp, Artificial Sequence
  Plasmid pKR1311
aattgatggcgcaacttatgatgtgtctgcttgggtcaatcaccaccctggaggagctgacattatcgagaactatcgcaaccgcgatgcgaccgatgtcttcatggtgatgcactctcaagaagccgtcgccaagttgaagagaatgcctgttatggagccttcctctcctgacacacctgttgcacccaagcctaagcgtgatgagccccaggaggatttccgcaagttgcgggaggaattcatctccaagggtatgttcgagacgagtttcctttggtatttttacaagacttcaactaccgtcggtttgatggtcctttccatcttgatgaccgtgtacacgaattggtatttcaccgctgctttggttcttggcgtgtgctaccaacagctaggctggttgtcccacgactattgccatcaccaggttttcacaaaccgcaagattaacgacgctttcggtctctttttcggtaacgtgatgcagggatactcacagacttggtggaaggataggcacaatggtcaccatgccgccaccaatgtggtcggccatgacccagatattgataacctccccatcctggcttggtctcccgaagatgtcaagagggctactccttcgactcggaatctcatcaagtaccagcagtactacttcattcccaccattgcatcccttaggttcatctggtgcctccaatccatcggcggcgtcatgtcctacaagagcgaggagaggaacctgtactacaagcgccagtacactaaggaggcgattggtctggccctccactgggtgctcaaggccactttctattgcagtgccatgcctagctttgccaccggtttgggatgcttcttgatctccgagctgctcggaggatttggcattgccatcgttgtgtttctgaatcactatcctttggacaaggttgaggagactgtctgggatgagcacgggttcagcgccagccagatccacgagacgttgaacattaagcccggccttctcaccgattgggtctttggtggtctcaactaccagattgagcaccacttgtggcccaacatgcccaggcacaacctcacggcagcttccctggaggtgcagaagttgtgcgccaagcacaacctgccctacagggccccagccatcatccccggggttcagaaattggtcagcttcttaggcgagattgcccagctggctgctgtccctgaacccgcccgtccagctggactcccgccggccacgtactacgactccctggcagtgtccggccgccaccgcggtggagctccagcttttgttccctttagtgagggttaatttcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgacggtatcgataagcttgatatcgaattcctgcagcccgggggatc

SEQ ID NO: 310 - DNA, 3201 bp, Artificial Sequence
  Plasmid pKR1304
aattcgatatcaagcttatcgataccgtcgacctcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctcgaaattaaccctcactaaagggaacaaaagctggagctccaccgcggtggcggccgcaccatgtctcctaagcggcaagctctgccaatcacaattgatggcgcaacttatgatgtgtctgcttgggtcaatcaccaccctggaggagctgacattatcgagaactatcgcaaccgcgatgcgaccgatgtcttcatggtgatgcactctcaagaagccgtcgccaagttgaagagaatgcctgttatggagccttcctctcctgacacacctgttgcacccaagcctaagcgtgatgagccccaggaggatttccgcaagttgcgggagg

SEQ ID NO: 311 - DNA, 4041 bp, Artificial Sequence
  Plasmid pKR1309
ggccgcaccatgtctcctaagcggcaagctctgccaatcacaattgatggcgcaacttatgatgtgtctgcttgggtcaatcaccaccctggaggagctgacattatcgagaactatcgcaaccgcgatgcgaccgatgtcttcatggtgatgcactctcaagaagccgtcgccaagttgaagagaatgcctgttatggagccttcctctcctgacacacctgttgcacccaagcctaagcgtgatgagccccaggaggatttccgcaagttgcgggaggaattcgatatcaagcttatcgataccgtcgacctcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctcgaaattaaccctcactaaagggaacaaaagctggagctccaccgcggtggcggccgcaccatggaagcagccaaagaattggtttccatcgtccaagaggagctccccaaggtggactatgcccagctttggcaggatgccagcagctgtgaggtcctttacctctcggtggcattcgtggcgatcaagttcatgctgcgcccactggacctgaagcgccaggccaccttgaagaagctgttcacagcatacaacttcctcatgtcgatctattcctttggctccttcctggccatggcctatgccctatcagtaactggcatcctctccggcgactgtgagacggcgttcaacaacgatgtgttcaggatcacaactcagctgttctacctcagcaagttcgtagagtacatcgactccttctaccttccccttatggacaagccactgtcgttccttcagttcttccatcatttgggggcccccattgacatgtggctattctacaaataccgcaacgaaggagtctggatctttgtcctgttgaatgggttcattcactggatcatgtacggttactattggacgcggctcatcaagctgaacttccccatgcccaagaacctgatcacctccatgcagatcatccagttcaatgtcgggttctacatcgtctggaagtaccgcaatgtgccatgctaccgccaggatgggatgcgcatgtttgcctggatcttcaactactggtatgtcgggacggtcttgctgctgttcctcaacttttacgtgcagacgtacatccggaagccgaggaagaaccgagggaagaaggagcccgcccgtccagctggactcccgccggccacgtactacgactccctggcagtgtcc

SEQ ID NO: 312 - DNA, 5604 bp, Artificial Sequence
  Plasmid pKR1313
ggccgccaccgcggtggagctccagcttttgttccctttagtgagggttaatttcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgacggtatcgataagcttgatatcgaattcctgcagcccgggggatcaattgatggcgcaacttatgatgtgtctgcttgggtcaatcaccaccctggaggagctgacattatcgagaactatcgcaaccgcgatgcgaccgatgtcttcatggtgatgcactctcaagaagccgtcgccaagttgaagagaatgcctgttatggagccttcctctcctgacacacctgttgcacccaagcctaagcgtgatgagccccaggaggatttccgcaagttgcgggaggaattcatctccaagggtatgttcgagacgagtttcctttggtatttttacaagacttcaactaccgtcggtttgatggtcctttccatcttgatgaccgtgtacacgaattggtatttcaccgctgctttggttcttggcgtgtgctaccaacagctaggctggttgtcccacgactattgccatcaccaggttttcacaaaccgcaagattaacgacgctttcggtctctttttcggtaacgtgatgcagggatactcacagacttggtggaaggataggcacaatggtcaccatgccgccaccaatgtggtcggccatgacccagatattgataacctccccatcctggcttggtctcccgaagatgtcaagagggctactccttcgactcggaatctcatcaagtaccagcagtactacttcattcccaccattgcatcccttaggttcatctggtgcctccaatccatcggcggcgtcatgtcctacaagagcgaggagaggaacctgtactacaagcgccagtacactaaggaggcgattggtctggccctccactgggtgctcaaggccactttctattgcagtgccatgcctagctttgccaccggtttgggatgcttcttgatctccgagctgctcggaggatttggcattgccatcgttgtgtttctgaatcactatcctttggacaaggttgaggagactgtctgggatgagcacgggttcagcgccagccagatccacgagacgttgaacattaagcccggccttctcaccgattgggtctttggtggtctcaactaccagattgagcaccacttgtggcccaacatgcccaggcacaacctcacggcagcttccctggaggtgcagaagttgtgcgccaagcacaacctgccctacagggccccagccatcatccccggggttcagaaattggtcagcttcttaggcgagattgcccagctggctgctgtccctgaacccgcccgtccagctggactcccgccggccacgtactacgactccctggcagtgtccggccgcaccatggccaccatctctttgactactgagcaacttttagaacacccagaactggttgcaattgatggggtgttgtacgatctcttcggactggcgaaagtgcatccaggtggcaacctcattgaagccgccggtgcctccgacggaaccgccctgttctactccatgcaccctggagtgaagccagagaattcgaagctgctgcagcaatttgcccgaggcaaacacgaacgaagctcgaaggacccagtgtacacctttgacagtcccttcgcccaggatgtcaagcagagcgttcgggaggtcatgaaggggcgcaactggtacgccacgcccggcttttggctgcggaccgcgctgatcatcgcgtgcactgccataggcgaatggtattggatcactaccggggcagtgatgtggggcatcttcaccgggtacttccacagccagattgggttggcgattcaacacgatgcctctcacggagccatcagcaaaaagccctgggtgaacgcctttttcgcctacggcatcgacgccattggatcctcccgctggatctggctgcagtcccacattatgcgccaccacacctacaccaaccagcatggcctggacctggacgctgcctcggcggagccgttcattttgttccactcctacccggcaacaaatgcgtcacgaaagtggtaccatcggttccaggcgtggtacatgtacatcgttttggggatgtatggtgtgtcgatggtgtacaatccgatgtacttgttcacgatgcagcacaacgacacaatcccagaggccacctctcttagaccaggcagctttttcaaccggcagcgcgccttcgccgtttccctccgcctactgttcatcttccgcaacgccttcctcccctggtacatcgcgggcgcctctccgctgctcaccatcctgctggtgccaacggtcacaggcatcttcttgacatttgtttttgtgctgtcccataactttgaaggcgctgagcggacccccgaaaagaactgcaaggccaaaagggccaaggaggggaaggaggtccgcgatgtagaggaggaccgggtggactggtaccgggcgcaggccgagaccgcggcgacctacgggggcagcgtcgggatgatgctgaccggcggtttgaacctgcagatcgagcaccacttgttcccccgcatgtcctcttggcactaccccttcatccaagatacggtgcgggaatgttgcaagcgccatggcgtgcgctacacatactacccgaccatcctggagaatataatgtccacgctccgctacatgcagaaggtgggcgtggcccacacaattcaggatgcccaggaattctgagc

SEQ ID NO: 313 - DNA, 6474 bp, Artificial Sequence
  Plasmid pKR1315
atcaagcttatcgataccgtcgacctcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctcgaaattaaccctcactaaagggaacaaaagctggagctccaccgcggtggcggccgcaccatggaagcagccaaagaattggtttccatcgtccaagaggagctccccaaggtggactatgcccagctttggcaggatgccagcagctgtgaggtcctttacctctcggtggcattcgtggcgatcaagttcatgctgcgcccactggacctgaagcgccaggccaccttgaagaagctgttcacagcatacaacttcctcatgtcgatctattcctttggctccttcctggccatggcctatgccctatcagtaactggcatcctctccggcgactgtgagacggcgttcaacaacgatgtgttcaggatcacaactcagctgttctacctcagcaagttcgtagagtacatcgactccttctaccttccccttatggacaagccactgtcgttccttcagttcttccatcatttgggggcccccattgacatgtggctattctacaaataccgcaacgaaggagtctggatctttgtcctgttgaatgggttcattcactggatcatgtacggttactattggacgcggctcatcaagctgaacttccccatgcccaagaacctgatcacctccatgcagatcatccagttcaatgtcgggttctacatcgtctggaagtaccgcaatgtgccatgctaccgccaggatgggatgcgcatgtttgcctggatcttcaactactggtatgtcgggacggtcttgctgctgttcctcaacttttacgtgcagacgtacatccggaagccgaggaagaaccgagggaagaaggagcccgcccgtccagctggactcccgccggccacgtactacgactccctggcagtgtccggccgcaccatgtctcctaagcggcaagctctgccaatcacaattgatggcgcaacttatgatgtgtctgcttgggtcaatcaccaccctggaggagctgacattatcgagaactatcgcaaccgcgatgcgaccgatgtcttcatggtgatgcactctcaagaagccgtcgccaagttgaagagaatgcctgttatggagccttcctctcctgacacacctgttgcacccaagcctaagcgtgatgagccccaggaggatttccgcaagttgcgggaggaattcatctccaagggtatgttcgagacgagtttcctttggtatttttacaagacttcaactaccgtcggtttgatggtcctttccatcttgatgaccgtgtacacgaattggtatttcaccgctgctttggttcttggcgtgtgctaccaacagctaggctggttgtcccacgactattgccatcaccaggttttcacaaaccgcaagattaacgacgctttcggtctctttttcggtaacgtgatgcagggatactcacagacttggtggaaggataggcacaatggtcaccatgccgccaccaatgtggtcggccatgacccagatattgataacctccccatcctggcttggtctcccgaagatgtcaagagggctactccttcgactcggaatctcatcaagtaccagcagtactacttcattcccaccattgcatcccttaggttcatctggtgcctccaatccatcggcggcgtcatgtcctacaagagcgaggagaggaacctgtactacaagcgccagtacactaaggaggcgattggtctggccctccactgggtgctcaaggccactttctattgcagtgccatgcctagctttgccaccggtttgggatgcttcttgatctccgagctgctcggaggatttggcattgccatcgttgtgtttctgaatcactatcctttggacaaggttgaggagactgtctgggatgagcacgggttcagcgccagccagatccacgagacgttgaacattaagcccggccttctcaccgattgggtctttggtggtctcaactaccagattgagcaccacttgtggcccaacatgcccaggcacaacctcacggcagcttccctggaggtgcagaagttgtgcgccaagcacaacctgccctacagggccccagccatcatccccggggttcagaaattggtcagcttcttaggcgagattgcccagctggctgctgtccctgaacccgcccgtccagctggactcccgccggccacgtactacgactccctggcagtgtccggccgcaccatggccaccatctctttgactactgagcaacttttagaacacccagaactggttgcaattgatggggtgttgtacgatctcttcggactggcgaaagtgcatccaggtggcaacctcattgaagccgccggtgcctccgacggaaccgccctgttctactccatgcaccctggagtgaagccagagaattcgaagctgctgcagcaatttgcccgaggcaaacacgaacgaagctcgaaggacccagtgtacacctttgacagtcccttcgcccaggatgtcaagcagagcgttcgggaggtcatgaaggggcgcaactggtacgccacgcccggcttttggctgcggaccgcgctgatcatcgcgtgcactgccataggcgaatggtattggatcactaccggggcagtgatgtggggcatcttcaccgggtacttccacagccagattgggttggcgattcaacacgatgcctctcacggagccatcagcaaaaagccctgggtgaacgcctttttcgcctacggcatcgacgccattggatcctcccgctggatctggctgcagtcccacattatgcgccaccacacctacaccaaccagcatggcctggacctggacgctgcctcggcggagccgttcattttgttccactcctacccggcaacaaatgcgtcacgaaagtggtaccatcggttccaggcgtggtacatgtacatcgttttggggatgtatggtgtgtcgatggtgtacaatccgatgtacttgttcacgatgcagcacaacgacacaatcccagaggccacctctcttagaccaggcagctttttcaaccggcagcgcgccttcgccgtttccctccgcctactgttcatcttccgcaacgccttcctcccctggtacatcgcgggcgcctctccgctgctcaccatcctgctggtgccaacggtcacaggcatcttcttgacatttgtttttgtgctgtcccataactttgaaggcgctgagcggacccccgaaaagaactgcaaggccaaaagggccaaggaggggaaggaggtccgcgatgtagaggaggaccgggtggactggtaccgggcgcaggccgagaccgcggcgacctacgggggcagcgtcgggatgatgctgaccggcggtttgaacctgcagatcgagcaccacttgttcccccgcatgtcctcttggcactaccccttcatccaagatacggtgcgggaatgttgcaagcgccatggcgtgcgctacacatactacccgaccatcctggagaatataatgtccacgctccgctacatgcagaaggtgggcgtggcccacacaattcaggatgcccaggaattctgagcggccgccaccgcggtggag

SEQ ID NO: 314 - DNA, 10627 bp, Artificial Sequence
  Plasmid pKR1322
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatggaagcagccaaagaattggtttccatcgtccaagaggagctccccaaggtggactatgcccagctttggcaggatgccagcagctgtgaggtcctttacctctcggtggcattcgtggcgatcaagttcatgctgcgcccactggacctgaagcgccaggccaccttgaagaagctgttcacagcatacaacttcctcatgtcgatctattcctttggctccttcctggccatggcctatgccctatcagtaactggcatcctctccggcgactgtgagacggcgttcaacaacgatgtgttcaggatcacaactcagctgttctacctcagcaagttcgtagagtacatcgactccttctaccttccccttatggacaagccactgtcgttccttcagttcttccatcatttgggggcccccattgacatgtggctattctacaaataccgcaacgaaggagtctggatctttgtcctgttgaatgggttcattcactggatcatgtacggttactattggacgcggctcatcaagctgaacttccccatgcccaagaacctgatcacctccatgcagatcatccagttcaatgtcgggttctacatcgtctggaagtaccgcaatgtgccatgctaccgccaggatgggatgcgcatgtttgcctggatcttcaactactggtatgtcgggacggtcttgctgctgttcctcaacttttacgtgcagacgtacatccggaagccgaggaagaaccgagggaagaaggagcccgcccgtccagctggactcccgccggccacgtactacgactccctggcagtgtccggccgcaccatgtctcctaagcggcaagctctgccaatcacaattgatggcgcaacttatgatgtgtctgcttgggtcaatcaccaccctggaggagctgacattatcgagaactatcgcaaccgcgatgcgaccgatgtcttcatggtgatgcactctcaagaagccgtcgccaagttgaagagaatgcctgttatggagccttcctctcctgacacacctgttgcacccaagcctaagcgtgatgagccccaggaggatttccgcaagttgcgggaggaattcatctccaagggtatgttcgagacgagtttcctttggtatttttacaagacttcaactaccgtcggtttgatggtcctttccatcttgatgaccgtgtacacgaattggtatttcaccgctgctttggttcttggcgtgtgctaccaacagctaggctggttgtcccacgactattgccatcaccaggttttcacaaaccgcaagattaacgacgctttcggtctctttttcggtaacgtgatgcagggatactcacagacttggtggaaggataggcacaatggtcaccatgccgccaccaatgtggtcggccatgacccagatattgataacctccccatcctggcttggtctcccgaagatgtcaagagggctactccttcgactcggaatctcatcaagtaccagcagtactacttcattcccaccattgcatcccttaggttcatctggtgcctccaatccatcggcggcgtcatgtcctacaagagcgaggagaggaacctgtactacaagcgccagtacactaaggaggcgattggtctggccctccactgggtgctcaaggccactttctattgcagtgccatgcctagctttgccaccggtttgggatgcttcttgatctccgagctgctcggaggatttggcattgccatcgttgtgtttctgaatcactatcctttggacaaggttgaggagactgtctgggatgagcacgggttcagcgccagccagatccacgagacgttgaacattaagcccggccttctcaccgattgggtctttggtggtctcaactaccagattgagcaccacttgtggcccaacatgcccaggcacaacctcacggcagcttccctggaggtgcagaagttgtgcgccaagcacaacctgccctacagggccccagccatcatccccggggttcagaaattggtcagcttcttaggcgagattgcccagctggctgctgtccctgaacccgcccgtccagctggactcccgccggccacgtactacgactccctggcagtgtccggccgcaccatggccaccatctctttgactactgagcaacttttagaacacccagaactggttgcaattgatggggtgttgtacgatctcttcggactggcgaaagtgcatccaggtggcaacctcattgaagccgccggtgcctccgacggaaccgccctgttctactccatgcaccctggagtgaagccagagaattcgaagctgctgcagcaatttgcccgaggcaaacacgaacgaagctcgaaggacccagtgtacacctttgacagtcccttcgcccaggatgtcaagcagagcgttcgggaggtcatgaaggggcgcaactggtacgccacgcccggcttttggctgcggaccgcgctgatcatcgcgtgcactgccataggcgaatggtattggatcactaccggggcagtgatgtggggcatcttcaccgggtacttccacagccagattgggttggcgattcaacacgatgcctctcacggagccatcagcaaaaagccctgggtgaacgcctttttcgcctacggcatcgacgccattggatcctcccgctggatctggctgcagtcccacattatgcgccaccacacctacaccaaccagcatggcctggacctggacgctgcctcggcggagccgttcattttgttccactcctacccggcaacaaatgcgtcacgaaagtggtaccatcggttccaggcgtggtacatgtacatcgttttggggatgtatggtgtgtcgatggtgtacaatccgatgtacttgttcacgatgcagcacaacgacacaatcccagaggccacctctcttagaccaggcagctttttcaaccggcagcgcgccttcgccgtttccctccgcctactgttcatcttccgcaacgccttcctcccctggtacatcgcgggcgcctctccgctgctcaccatcctgctggtgccaacggtcacaggcatcttcttgacatttgtttttgtgctgtcccataactttgaaggcgctgagcggacccccgaaaagaactgcaaggccaaaagggccaaggaggggaaggaggtccgcgatgtagaggaggaccgggtggactggtaccgggcgcaggccgagaccgcggcgacctacgggggcagcgtcgggatgatgctgaccggcggtttgaacctgcagatcgagcaccacttgttcccccgcatgtcctcttggcactaccccttcatccaagatacggtgcgggaatgttgcaagcgccatggcgtgcgctacacatactacccgaccatcctggagaatataatgtccacgctccgctacatgcagaaggtgggcgtggcccacacaattcaggatgcccaggaattctgagc

SEQ ID NO: 315 - DNA, 14688 bp, Artificial Sequence
  Plasmid pZKLeuN-29E3
cgattgttgtctactaactatcgtacgataacttcgtatagcatacattatacgaagttatcgcgtcgacgagtatctgtctgactcgtcattgccgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagctaacgtccacaagtccgcctttgccgctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtacccggaaccggaatcattgctggcctgcgagctggtgccgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgacttattctcaactacatccccagtcacaataccaccactgcactaccactacaccaaaaccatgatcaaaccacccatggacttcctggaggcagaagaacttgttatggaaaagctcaagagagagatcataacttcgtatagcatacattatacgaagttatcctgcaggtaaaggaattctggagtttctgagagaaaaaggcaagatacgtatgtaacaaagcgacgcatggtacaataataccggaggcatgtatcatagagagttagtggttcgatgatggcactggtgcctggtatgactttatacggctgactacatatttgtcctcagacatacaattacagtcaagcacttacccttggacatctgtaggtaccccccggccaagacgatctcagcgtgtcgtatgtcggattggcgtagctccctcgctcgtcaattggctcccatctactttcttctgcttggctacacccagcatgtctgctatggctcgttttcgtgccttatctatcctcccagtattaccaactctaaatgacatgatgtgattgggtctacactttcatatcagagataaggagtagcacagttgcataaaaagcccaactctaatcagcttcttcctttcttgtaattagtacaaaggtgattagcgaaatctggaagcttagttggccctaaaaaaatcaaaaaaagcaaaaaacgaaaaacgaaaaaccacagttttgagaacagggaggtaacgaaggatcgtatatatatatatatatatatatacccacggatcccgagaccggcctttgattcttccctacaaccaaccattctcaccaccctaattcacaaccatggagtctggacccatgcctgctggcattcccttccctgagtactatgacttctttatggactggaagactcccctggccatcgctgccacctacactgctgccgtcggtctcttcaaccccaaggttggcaaggtctcccgagtggttgccaagtcggctaacgcaaagcctgccgagcgaacccagtccggagctgccatgactgccttcgtctttgtgcacaacctcattctgtgtgtctactctggcatcaccttctactacatgtttcctgctatggtcaagaacttccgaacccacacactgcacgaagcctactgcgacacggatcagtccctctggaacaacgcacttggctactggggttacctcttctacctgtccaagttctacgaggtcattgacaccatcatcatcatcctgaagggacgacggtcctcgctgcttcagacctaccaccatgctggagccatgattaccatgtggtctggcatcaactaccaagccactcccatttggatctttgtggtcttcaactccttcattcacaccatcatgtactgttactatgccttcacctctatcggattccatcctcctggcaaaaagtacctgacttcgatgcagattactcagtttctggtcggtatcaccattgccgtgtcctacctcttcgttcctggctgcatccgaacacccggtgctcagatggctgtctggatcaacgtcggctacctgtttcccttgacctatctgttcgtggactttgccaagcgaacctactccaagcgatctgccattgccgctcagaaaaaggctcagtaagcggccgcattgatgattggaaacacacacatgggttatatctaggtgagagttagttggacagttatatattaaatcagctatgccaacggtaacttcattcatgtcaacgaggaaccagtgactgcaagtaatatagaatttgaccaccttgccattctcttgcactcctttactatatctcatttatttcttatatacaaatcacttcttcttcccagcatcgagctcggaaacctcatgagcaataacatcgtggatctcgtcaatagagggctttttggactccttgctgttggccaccttgtccttgctgtctggctcattctgtttcaacgccttttaattaacggagtaggtctcggtgtcggaagcgacgccagatccgtcatcctcctttcgctctccaaagtagatacctccgacgagctctcggacaatgatgaagtcggtgccctcaacgtttcggatgggggagagatcggcgagcttgggcgacagcagctggcagggtcgcaggttggcgtacaggttcaggtcctttcgcagcttgaggagaccctgctcgggtcgcacgtcggttcgtccgtcgggagtggtccatacggtgttggcagcgcctccgacagcaccgagcataatagagtcagcctttcggcagatgtcgagagtagcgtcggtgatgggctcgccctccttctcaatggcagctcctccaatgagtcggtcctcaaacacaaactcggtgccggaggcctcagcaacagacttgagcaccttgacggcctcggcaatcacctcggggccacagaagtcgccgccgagaagaacaatcttcttggagtcagtcttggtcttcttagtttcgggttccattgtggatgtgtgtggttgtatgtgtgatgtggtgtgtggagtgaaaatctgtggctggcaaacgctcttgtatatatacgcacttttgcccgtgctatgtggaagactaaacctccgaagattgtgactcaggtagtgcggtatcggctagggacccaaaccttgtcgatgccgatagcatgcgacgtcgggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcgcgcccactgagctcgtctaacggacttgatatacaaccaattaaaacaaatgaaaagaaatacagttctttgtatcatttgtaacaattaccctgtacaaactaaggtattgaaatcccacaatattcccaaagtccacccctttccaaattgtcatgcctacaactcatataccaagcactaacctaccaaacaccactaaaaccccacaaaatatatcttaccgaatatacagtaacaagctaccaccacactcgttgggtgcagtcgccagcttaaagatatctatccacatcagccacaactcccttcctttaataaaccgactacacccttggctattgaggttatgagtgaatatactgtagacaagacactttcaagaagactgtttccaaaacgtaccactgtcctccactacaaacacacccaatctgcttcttctagtcaaggttgctacaccggtaaattataaatcatcatttcattagcagggcagggccctttttatagagtcttatacactagcggaccctgccggtagaccaacccgcaggcgcgtcagtttgctccttccatcaatgcgtcgtagaaacgacttactccttcttgagcagctccttgaccttgttggcaacaagtctccgacctcggaggtggaggaagagcctccgatatcggcggtagtgataccagcctcgacggactccttgacggcagcctcaacagcgtcaccggcgggcttcatgttaagagagaacttgagcatcatggcggcagacagaatggtggcgtacgcaactaacatgaatgaatacgatatacatcaaagactatgatacgcagtattgcacactgtacgagtaagagcactagccactgcactcaagtgaaaccgttgcccgggtacgagtatgagtatgtacagtatgtttagtattgtacttggacagtgcttgtatcgtacattctcaagtgtcaaacataaatatccgttgctatatcctcgcaccaccacgtagctcgctatatccctgtgttgaatccatccatcttggattgccaattgtgcacacagaaccgggcactcacttccccatccacacttgcggccgcttaagcaacgggcttgataacagcggggggggtgcccacgttgttgcggttgcggaagaacagaacacccttaccagcaccctcggcaccagcgctgggctcaacccactggcacatacgcgcactgcggtacatggcgcggatgaagccacgaggaccatcctggacatcagcccggtagtgcttgcccatgatgggcttaatggcctcggtggcctcgtccgcgttgtagaaggggatgctgctgacgtagtggtggaggacatgagtctcgatgatgccgtggagaaggtggcggccgatgaagcccatctcacggtcaatggtagcagcggcaccacggacgaagttccactcgtcgttggtgtagtggggaagggtagggtcggtgtgctggaggaaggtgatggcaacgagccagtggttaacccagaggtagggaacaaagtaccagatggccatgttgtagaaaccgaacttctgaacgaggaagtacagagcagtggccatcagaccgataccaatatcgctgaggacgatgagcttagcgtcactgttctcgtacagagggctgcggggatcgaagtggttaacaccaccgccgaggccgttatgcttgcccttgccgcgaccctcacgctggcgctcgtggtagttgtggccggtaacattggtgatgaggtagttgggccagccaacgagctgctgaaggacgagcatgagaagagtgaaagcgggggtctcctcagtaagatgagcgagctcgtgggtcatctttccgagacgagtagcctgctgctcgcgggttcggggaacgaagaccatgtcacgctccatgttgccagtggccttgtggtgctttcggtgggagatttgccagctgaagtaggggacaaggagggaagagtgaagaacccagccagtaatgtcgttgatgatgcgagaatcggagaaagcaccgtgaccgcactcatgggcaataacccagagaccagtaccgaaaagaccctgaagaacggtgtacacggcccacagaccagcgcgggcgggggtggaggggatatattcgggggtcacaaagttgtaccagatgctgaaagtggtagtcaggaggacaatgtcgcggaggatataaccgtatcccttgagagcggagcgcttgaagcagtgcttagggatggcattgtagatgtccttgatggtaaagtcgggaacctcgaactggttgccgtaggtgtcgagcatgacaccatactcggacttgggcttggcgatatcaacctcggacatggacgagagcgatgtggaagaggccgagtggcggggagagtctgaaggagagacggcggcagactcagaatccgtcacagtagttgaggtgacggtgcgtctaagcgcagggttctgcttgggcagagccgaagtggacgccatggttgatgtgtgtttaattcaagaatgaatatagagaagagaagaagaaaaaagattcaattgagccggcgatgcagacccttatataaatgttgccttggacagacggagcaagcccgcccaaacctacgttcggtataatatgttaagctttttaacacaaaggtttggcttggggtaacctgatgtggtgcaaaagaccgggcgttggcgagccattgcgcgggcgaatggggccgtgactcgtctcaaattcgagggcgtgcctcaattcgtgcccccgtggctttttcccgccgtttccgccccgtttgcaccactgcagccgcttctttggttcggacaccttgctgcgagctaggtgccttgtgctacttaaaaagtggcctcccaacaccaacatgacatgagtgcgtgggccaagacacgttggcggggtcgcagtcggctcaatggcccggaaaaaacgctgctggagctggttcggacgcagtccgccgcggcgtatggatatccgcaaggttccatagcgccattgccctccgtcggcgtctatcccgcaacctctaaatagagcgggaatataacccaagcttcttttttttcctttaacacgcacacccccaactatcatgttgctgctgctgtttgactctactctgtggaggggtgctcccacccaacccaacctacaggtggatccggcgctgtgattggctgataagtctcctatccggactaattctgaccaatgggacatgcgcgcaggacccaaatgccgcaattacgtaaccccaacgaaatgcctacccctctttggagcccagcggccccaaatccccccaagcagcccggttctaccggcttccatctccaagcacaagcagcccggttctaccggcttccatctccaagcacccctttctccacaccccacaaaaagacccgtgcaggacatcctactgcgtcgacatcatttaaattccttcacttcaagttcattcttcatctgcttctgttttactttgacaggcaaatgaagacatggtacgacttgatggaggccaagaacgccatttcaccccgagacaccgaagtgcctgaaatcctggctgcccccattgataacatcggaaactacggtattccggaaagtgtatatagaacctttccccagcttgtgtctgtggatatggatggtgtaatcccctttgagtactcgtcttggcttctctccgagcagtatgaggctctctaatctagcgcatttaatatctcaatgtatttatatatttatcttctcatgcggccgctcactgaatctttttggctcccttgtgcttcctgacgatatacgtttgcacatagaaattcaagaacaaacacaagactgtgccaacataaaagtaattgaagaaccagccaaacatcctcatcccatcttggcgataacagggaatgttcctgtacttccagacaatgtagaaaccaacattgaattgaatgatctgcattgatgtaatcagggattttggcatggggaacttcagcttgatcaatctggtccaataataaccgtacatgatccagtggatgaaaccattcaacagcacaaaaatccaaacagcttcatttcggtaattatagaacagccacatatccatcggtgcccccaaatgatggaagaattgcaaccaggtcagaggcttgcccatcagtggcaaatagaaggagtcaatatactccaggaacttgctcaaatagaacaactgcgtggtgatcctgaagacgttgttgtcaaaagccttctcgcagttgtcagacataacaccgatggtgtacatggcatatgccattgagaggaatgatcccaacgaataaatggacatgagaaggttgtaattggtgaaaacaaacttcatacgagactgaccttttggaccaagggggccaagagtgaacttcaagatgacaaatgcgatggacaagtaaagcacctcacagtgactggcatcactccagagttgggcataatcaactggttgggtaaaacttcctgcccaattgagactatttcattcaccacctccatggccattgctgtagatatgtcttgtgtgtaagggggttggggtggttgtttgtgttcttgacttttgtgttagcaagggaagacgggcaaaaaagtgagtgtggttgggagggagagacgagccttatatataatgcttgtttgtgtttgtgcaagtggacgccgaaacgggcaggagccaaactaaacaaggcagacaatgcgagcttaattggattgcctgatgggcaggggttagggctcgatcaatgggggtgcgaagtgacaaaattgggaattaggttcgcaagcaaggctgacaagactttggcccaaacatttgtacgcggtggacaacaggagccacccatcgtctgtcacgggctagccggtcgtgcgtcctgtcaggctccacctaggctccatgccactccatacaatcccactagtgtaccgctaggccgcttttagctcccatctaagacccccccaaaacctccactgtacagtgcactgtactgtgtggcgatcaagggcaagggaaaaaaggcgcaaacatgcacgcatggaatgacgtaggtaaggcgttactagactgaaaagtggcacatttcggcgtgccaaagggtcctaggtgcgtttcgcgagctgggcgccaggccaagccgctccaaaacgcctctccgactccctccagcggcctccatatccccatccctctccacagcaatgttgttaagccttgcaaacgaaaaaatagaaaggctaataagcttccaatattgtggtgtacgctgcataacgcaacaatgagcgccaaacaacacacacacacagcacacagcagcattaaccacgatgaacagcatgacattacaggtgggtgtgtaatcagggccctgattgctggtggtgggagcccccatcatgggcagatctgcgtacactgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggaggtcgtgaacgaaatcgtctccattggccaggaggttcttcccaaggtcgactatgctcagctctggtctgatgcctcgcactgcgaggtgctgtacctctccatcgccttcgtcatcctgaagttcacccttggtcctctcggacccaagggtcagtctcgaatgaagtttgtgttcaccaactacaacctgctcatgtccatctactcgctgggctccttcctctctatggcctacgccatgtacaccattggtgtcatgtccgacaactgcgagaaggctttcgacaacaatgtcttccgaatcaccactcagctgttctacctcagcaagttcctcgagtacattgactccttctatctgcccctcatgggcaagcctctgacctggttgcagttctttcaccatctcggagctcctatggacatgtggctgttctacaactaccgaaacgaagccgtttggatctttgtgctgctcaacggcttcattcactggatcatgtacggctactattggacccgactgatcaagctcaagttccctatgcccaagtccctgattacttctatgcagatcattcagttcaacgttggcttctacatcgtctggaagtaccggaacattccctgctaccgacaagatggaatgagaatgtttggctggtttttcaactacttctacgttggtactgtcctgtgtctgttcctcaacttctacgtgcagacctacatcgtccgaaagcacaagggagccaaaaagattcagtgagcggccgcatgtacatacaagattatttatagaaatgaatcgcgatcgaacaaagagtacgagtgtacgagtaggggatgatgataaaagtggaagaagttccgcatctttggatttatcaacgtgtaggacgatacttcctgtaaaaatgcaatgtctttaccataggttctgctgtagatgttattaactaccattaacatgtctacttgtacagttgcagaccagttggagtatagaatggtacacttaccaaaaagtgttgatggttgtaactacgatatataaaactgttgacgggatccccgctgatatgcctaaggaacaatcaaagaggaagatattaattcagaatgctagtatacagttagggat

SEQ ID NO: 316 - DNA, 1434 bp, Fusarium monoliforme
  CDS (1)..(1434): delta-12 desaturase
  ref <302>: TITLE: DELTA-12 DESATURASES SUITABLE FOR ALTERING LEVELS OF POLYUNSATURATED FATTY ACIDS IN OLEAGINOUS YEAST
  ref <310>: PATENT DOCUMENT NUMBER: WO 2005/047485
  ref <311>: PATENT FILING DATE: 2004-11-12
  ref <312>: PUBLICATION DATE: 2005-05-26
  ref <313>: RELEVANT RESIDUES IN SEQ ID NO: (1)..(1434)
  ref <302>: TITLE: DELTA-12 DESATURASES SUITABLE FOR ALTERING LEVELS OF POLYUNSATURATED FATTY ACIDS IN OLEAGINOUS YEAST
  ref <310>: PATENT DOCUMENT NUMBER: US 2005-0216975-A1
  ref <311>: PATENT FILING DATE: 2004-11-10
  ref <312>: PUBLICATION DATE: 2005-09-29
  ref <313>: RELEVANT RESIDUES IN SEQ ID NO: (1)..(1434)
atggcgtccacttcggctctgcccaagcagaaccctgcgcttagacgcaccgtcacctcaactactgtgacggattctgagtctgccgccgtctctccttcagactctccccgccactcggcctcttccacatcgctctcgtccatgtccgaggttgatatcgccaagcccaagtccgagtatggtgtcatgctcgacacctacggcaaccagttcgaggttcccgactttaccatcaaggacatctacaatgccatccctaagcactgcttcaagcgctccgctctcaagggatacggttatatcctccgcgacattgtcctcctgactaccactttcagcatctggtacaactttgtgacccccgaatatatcccctccacccccgcccgcgctggtctgtgggccgtgtacaccgttcttcagggtcttttcggtactggtctctgggttattgcccatgagtgcggtcacggtgctttctccgattctcgcatcatcaacgacattactggctgggttcttcactcttccctccttgtcccctacttcagctggcaaatctcccaccgaaagcaccacaaggccactggcaacatggagcgtgacatggtcttcgttccccgaacccgcgagcagcaggctactcgtctcggaaagatgacccacgagctcgctcatcttactgaggagacccccgctttcactcttctcatgctcgtccttcagcagctcgttggctggcccaactacctcatcaccaatgttaccggccacaactaccacgagcgccagcgtgagggtcgcggcaagggcaagcataacggcctcggcggtggtgttaaccacttcgatccccgcagccctctgtacgagaacagtgacgctaagctcatcgtcctcagcgatattggtatcggtctgatggccactgctctgtacttcctcgttcagaagttcggtttctacaacatggccatctggtactttgttccctacctctgggttaaccactggctcgttgccatcaccttcctccagcacaccgaccctacccttccccactacaccaacgacgagtggaacttcgtccgtggtgccgctgctaccattgaccgtgagatgggcttcatcggccgccaccttctccacggcatcatcgagactcatgtcctccaccactacgtcagcagcatccccttctacaacgcggacgaggccaccgaggccattaagcccatcatgggcaagcactaccgggctgatgtccaggatggtcctcgtggcttcatccgcgccatgtaccgcagtgcgcgtatgtgccagtgggttgagcccagcgctggtgccgagggtgctggtaagggtgttctgttcttccgcaaccgcaacaacgtgggcaccccccccgctgttatcaagcccgttgcttaa

SEQ ID NO: 317 - protein, 477 aa, Fusarium monoliforme
MASTSALPKQNPALRRTVTSTTVTDSESAAVSPSDSPRHSASSTSLSSMSEVDIAKPKSEYGVMLDTYGNQFEVPDFTIKDIYNAIPKHCFKRSALKGYGYILRDIVLLTTTFSIWYNFVTPEYIPSTPARAGLWAVYTVLQGLFGTGLWVIAHECGHGAFSDSRIINDITGWVLHSSLLVPYFSWQISHRKHHKATGNMERDMVFVPRTREQQATRLGKMTHELAHLTEETPAFTLLMLVLQQLVGWPNYLITNVTGHNYHERQREGRGKGKHNGLGGGVNHFDPRSPLYENSDAKLIVLSDIGIGLMATALYFLVQKFGFYNMAIWYFVPYLWVNHWLVAITFLQHTDPTLPHYTNDEWNFVRGAAATIDREMGFIGRHLLHGIIETHVLHHYVSSIPFYNADEATEAIKPIMGKHYRADVQDGPRGFIRAMYRSARMCQWVEPSAGAEGAGKGVLFFRNRNNVGTPPAVIKPVA

SEQ ID NO: 318 - DNA, 777 bp, Euglena gracilis
  CDS (1)..(777): synthetic delta-9 elongase (codon-optimized for Yarrowia lipolytica)
  ref <302>: TITLE: DELTA-9 ELONGASES AND THEIR USE IN MAKING POLYUNSATURATED FATTY ACIDS
  ref <310>: PATENT DOCUMENT NUMBER: WO 2007/061742
  ref <311>: PATENT FILING DATE: 2006-11-16
  ref <312>: PUBLICATION DATE: 2007-05-31
  ref <313>: RELEVANT RESIDUES IN SEQ ID NO: (1)..(777)
  ref <302>: TITLE: DELTA-9 ELONGASES AND THEIR USE IN MAKING POLYUNSATURATED FATTY ACIDS
  ref <310>: PATENT DOCUMENT NUMBER: US-2007-0117190-A1
  ref <311>: PATENT FILING DATE: 2006-11-16
  ref <312>: PUBLICATION DATE: 2007-05-24
  ref <313>: RELEVANT RESIDUES IN SEQ ID NO: (1)..(777)
atggaggtcgtgaacgaaatcgtctccattggccaggaggttcttcccaaggtcgactatgctcagctctggtctgatgcctcgcactgcgaggtgctgtacctctccatcgccttcgtcatcctgaagttcacccttggtcctctcggacccaagggtcagtctcgaatgaagtttgtgttcaccaactacaacctgctcatgtccatctactcgctgggctccttcctctctatggcctacgccatgtacaccattggtgtcatgtccgacaactgcgagaaggctttcgacaacaatgtcttccgaatcaccactcagctgttctacctcagcaagttcctcgagtacattgactccttctatctgcccctcatgggcaagcctctgacctggttgcagttctttcaccatctcggagctcctatggacatgtggctgttctacaactaccgaaacgaagccgtttggatctttgtgctgctcaacggcttcattcactggatcatgtacggctactattggacccgactgatcaagctcaagttccctatgcccaagtccctgattacttctatgcagatcattcagttcaacgttggcttctacatcgtctggaagtaccggaacattccctgctaccgacaagatggaatgagaatgtttggctggtttttcaactacttctacgttggtactgtcctgtgtctgttcctcaacttctacgtgcagacctacatcgtccgaaagcacaagggagccaaaaagattcagtga

SEQ ID NO: 319 - protein, 258 aa, Euglena gracilis
MEVVNEIVSIGQEVLPKVDYAQLWSDASHCEVLYLSIAFVILKFTLGPLGPKGQSRMKFVFTNYNLLMSIYSLGSFLSMAYAMYTIGVMSDNCEKAFDNNVFRITTQLFYLSKFLEYIDSFYLPLMGKPLTWLQFFHHLGAPMDMWLFYNYRNEAVWIFVLLNGFIHWIMYGYYWTRLIKLKFPMPKSLITSMQIIQFNVGFYIVWKYRNIPCYRQDGMRMFGWFFNYFYVGTVLCLFLNFYVQTYIVRKHKGAKKIQ

SEQ ID NO: 320 - DNA, 34 bp, Escherichia coli
ataacttcgtataatgtatgctatacgaagttat

SEQ ID NO: 321 - DNA, 828 bp, Mortierella alpina
  CDS (1)..(828): synthetic C16/18 elongase (codon-optimized for Yarrowia lipolytica)
  ref <302>: TITLE: A MORTIERELLA ALPINA C16/18 FATTY ACID ELONGASE
  ref <310>: PATENT DOCUMENT NUMBER: US 2007-0087420-A1
  ref <311>: PATENT FILING DATE: 2005-10-19
  ref <312>: PUBLICATION DATE: 2007-04-19
  ref <313>: RELEVANT RESIDUES IN SEQ ID NO: (1)..(828)
  ref <302>: TITLE: A MORTIERELLA ALPINA C16/18 FATTY ACID ELONGASE
  ref <310>: PATENT DOCUMENT NUMBER: WO 2007/046817
  ref <311>: PATENT FILING DATE: 2005-11-04
  ref <312>: PUBLICATION DATE: 2007-04-26
  ref <313>: RELEVANT RESIDUES IN SEQ ID NO: (1)..(828)
atggagtctggacccatgcctgctggcattcccttccctgagtactatgacttctttatggactggaagactcccctggccatcgctgccacctacactgctgccgtcggtctcttcaaccccaaggttggcaaggtctcccgagtggttgccaagtcggctaacgcaaagcctgccgagcgaacccagtccggagctgccatgactgccttcgtctttgtgcacaacctcattctgtgtgtctactctggcatcaccttctactacatgtttcctgctatggtcaagaacttccgaacccacacactgcacgaagcctactgcgacacggatcagtccctctggaacaacgcacttggctactggggttacctcttctacctgtccaagttctacgaggtcattgacaccatcatcatcatcctgaagggacgacggtcctcgctgcttcagacctaccaccatgctggagccatgattaccatgtggtctggcatcaactaccaagccactcccatttggatctttgtggtcttcaactccttcattcacaccatcatgtactgttactatgccttcacctctatcggattccatcctcctggcaaaaagtacctgacttcgatgcagattactcagtttctggtcggtatcaccattgccgtgtcctacctcttcgttcctggctgcatccgaacacccggtgctcagatggctgtctggatcaacgtcggctacctgtttcccttgacctatctgttcgtggactttgccaagcgaacctactccaagcgatctgccattgccgctcagaaaaaggctcagtaa

SEQ ID NO: 322 - protein, 275 aa, Mortierella alpina
MESGPMPAGIPFPEYYDFFMDWKTPLAIAATYTAAVGLFNPKVGKVSRVVAKSANAKPAERTQSGAAMTAFVFVHNLILCVYSGITFYYMFPAMVKNFRTHTLHEAYCDTDQSLWNNALGYWGYLFYLSKFYEVIDTIIIILKGRRSSLLQTYHHAGAMITMWSGINYQATPIWIFVVFNSFIHTIMYCYYAFTSIGFHPPGKKYLTSMQITQFLVGITIAVSYLFVPGCIRTPGAQMAVWINVGYLFPLTYLFVDFAKRTYSKRSAIAAQKKAQ

SEQ ID NO: 323 - DNA, 8739 bp, Artificial Sequence
  Plasmid pY116
ggccgccaccgcggcccgagattccggcctcttcggccgccaagcgacccgggtggacgtctagaggtacctagcaattaacagatagtttgccggtgataattctcttaacctcccacactcctttgacataacgatttatgtaacgaaactgaaatttgaccagatattgtgtccgcggtggagctccagcttttgttccctttagtgagggtttaaacgagcttggcgtaatcatggtcatagctgtttcctgtgtgaaattgttatccgctcacaattccacacaacgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaaccgatttcgacagtaattaattaatttgaatcgaatcggagcctaaaatgaacccgagtatatctcataaaattctcggtgagaggtctgtgactgtcagtacaaggtgccttcattatgccctcaaccttaccatacctcactgaatgtagtgtacctctaaaaatgaaatacagtgccaaaagccaaggcactgagctcgtctaacggacttgatatacaaccaattaaaacaaatgaaaagaaatacagttctttgtatcatttgtaacaattaccctgtacaaactaaggtattgaaatcccacaatattcccaaagtccacccctttccaaattgtcatgcctacaactcatataccaagcactaacctaccaaacaccactaaaaccccacaaaatatatcttaccgaatatacagtaacaagctaccaccacactcgttgggtgcagtcgccagcttaaagatatctatccacatcagccacaactcccttcctttaataaaccgactacacccttggctattgaggttatgagtgaatatactgtagacaagacactttcaagaagactgtttccaaaacgtaccactgtcctccactacaaacacacccaatctgcttcttctagtcaaggttgctacaccggtaaattataaatcatcatttcattagcagggcagggccctttttatagagtcttatacactagcggaccctgccggtagaccaacccgcaggcgcgtcagtttgctccttccatcaatgcgtcgtagaaacgacttactccttcttgagcagctccttgaccttgttggcaacaagtctccgacctcggaggtggaggaagagcctccgatatcggcggtagtgataccagcctcgacggactccttgacggcagcctcaacagcgtcaccggcgggcttcatgttaagagagaacttgagcatcatggcggcagacagaatggtggcaatggggttgaccttctgcttgccgagatcgggggcagatccgtgacagggctcgtacagaccgaacgcctcgttggtgtcgggcagagaagccagagaggcggagggcagcagacccagagaaccggggatgacggaggcctcgtcggagatgatatcgccaaacatgttggtggtgatgatgataccattcatcttggagggctgcttgatgaggatcatggcggccgagtcgatcagctggtggttgagctcgagctgggggaattcgtccttgaggactcgagtgacagtctttcgccaaagtcgagaggaggccagcacgttggccttgtcaagagaccacacgggaagaggggggttgtgctgaagggccaggaaggcggccattcgggcaattcgctcaacctcaggaacggagtaggtctcggtgtcggaagcgacgccagatccgtcatcctcctttcgctctccaaagtagatacctccgacgagctctcggacaatgatgaagtcggtgccctcaacgtttcggatgggggagagatcggcgagcttgggcgacagcagctggcagggtcgcaggttggcgtacaggttcaggtcctttcgcagcttgaggagaccctgctcgggtcgcacgtcggttcgtccgtcgggagtggtccatacggtgttggcagcgcctccgacagcaccgagcataatagagtcagcctttcggcagatgtcgagagtagcgtcggtgatgggctcgccctccttctcaatggcagctcctccaatgagtcggtcctcaaacacaaactcggtgccggaggcctcagcaacagacttgagcaccttgacggcctcggcaatcacctcggggccacagaagtcgccgccgagaagaacaatcttcttggagtcagtcttggtcttcttagtttcgggttccattgtggatgtgtgtggttgtatgtgtgatgtggtgtgtggagtgaaaatctgtggctggcaaacgctcttgtatatatacgcacttttgcccgtgctatgtggaagactaaacctccgaagattgtgactcaggtagtgcggtatcggctagggacccaaaccttgtcgatgccgatagcgctatcgaacgtaccccagccggccgggagtatgtcggaggggacatacgagatcgtcaagggtttgtggccaactggtatttaaatgtagctaacggtagcaggcgaactactggtacatacctcccccggaatatgtacaggcataatgcgtatctgtgggacatgtggtcgttgcgccattatgtaagcagcgtgtactcctctgactgtccatatggtttgctccatctcaccctcatcgttttcattgttcacaggcggccacaaaaaaactgtcttctctccttctctcttcgccttagtctactcggaccagttttagtttagcttggcgccactggataaatgagacctcaggccttgtgatgaggaggtcacttatgaagcatgttaggaggtgcttgtatggatagagaagcacccaaaataataagaataataataaaacagggggcgttgtcatttcatatcgtgttttcaccatcaatacacctccaaacaatgcccttcatgtggccagccccaatattgtcctgtagttcaactctatgcagctcgtatcttattgagcaagtaaaactctgtcagccgatattgcccgacccgcgacaagggtcaacaaggtggtgtaaggccttcgcagaagtcaaaactgtgccaaacaaacatctagagtctctttggtgtttctcgcatatatttwatcggctgtcttacgtatttgcgcctcggtaccggactaatttcggatcatccccaatacgctttttcttcgcagctgtcaacagtgtccatgatctatccacctaaatgggtcatatgaggcgtataatttcgtggtgctgataataattcccatatatttgacacaaaacttccccccctagacatacatctcacaatctcacttcttgtgcttctgtcacacatctcctccagctgacttcaactcacacctctgccccagttggtctacagcggtataaggtttctccgcatagaggtgcaccactcctcccgatacttgtttgtgtgacttgtgggtcacgacatatatatctacacacattgcgccaccctttggttcttccagcacaacaaaaacacgacacgctaaccatggccaatttactgaccgtacaccaaaatttgcctgcattaccggtcgatgcaacgagtgatgaggttcgcaagaacctgatggacatgttcagggatcgccaggcgttttctgagcatacctggaaaatgcttctgtccgtttgccggtcgtgggcggcatggtgcaagttgaataaccggaaatggtttcccgcagaacctgaagatgttcgcgattatcttctatatcttcaggcgcgcggtctggcagtaaaaactatccagcaacatttgggccagctaaacatgcttcatcgtcggtccgggctgccacgaccaagtgacagcaatgctgtttcactggttatgcggcggatccgaaaagaaaacgttgatgccggtgaacgtgcaaaacaggctctagcgttcgaacgcactgatttcgaccaggttcgttcactcatggaaaatagcgatcgctgccaggatatacgtaatctggcatttctggggattgcttataacaccctgttacgtatagccgaaattgccaggatcagggttaaagatatctcacgtactgacggtgggagaatgttaatccatattggcagaacgaaaacgctggttagcaccgcaggtgtagagaaggcacttagcctgggggtaactaaactggtcgagcgatggatttccgtctctggtgtagctgatgatccgaataactacctgttttgccgggtcagaaaaaatggtgttgccgcgccatctgccaccagccagctatcaactcgcgccctggaagggatttttgaagcaactcatcgattgatttacggcgctaaggatgactctggtcagagatacctggcctggtctggacacagtgcccgtgtcggagccgcgcgagatatggcccgcgctggagtttcaataccggagatcatgcaagctggtggctggaccaatgtaaatattgtcatgaactatatccgtaacctggatagtgaaacaggggcaatggtgcgcctgctggaagatggcgattaagc

SEQ ID NO: 324 - DNA, 15337 bp, Artificial Sequence
  Plasmid pKO2UF8289
cgatcgaggaagaggacaagcggctgcttcttaagtttgtgacatcagtatccaaggcaccattgcaaggattcaaggctttgaacccgtcatttgccattcgtaacgctggtagacaggttgatcggttccctacggcctccacctgtgtcaatcttctcaagctgcctgactatcaggacattgatcaacttcggaagaaacttttgtatgccattcgatcacatgctggtttcgatttgtcttagaggaacgcatatacagtaatcatagagaataaacgatattcatttattaaagtagatagttgaggtagaagttgtaaagagtgataaatagcggccgctcactgaatctttttggctcccttgtgcttcctgacgatatacgtttgcacatagaaattcaagaacaaacacaagactgtgccaacataaaagtaattgaagaaccagccaaacatcctcatcccatcttggcgataacagggaatgttcctgtacttccagacaatgtagaaaccaacattgaattgaatgatctgcattgatgtaatcagggattttggcatggggaacttcagcttgatcaatctggtccaataataaccgtacatgatccagtggatgaaaccattcaacagcacaaaaatccaaacagcttcatttcggtaattatagaacagccacatatccatcggtgcccccaaatgatggaagaattgcaaccaggtcagaggcttgcccatcagtggcaaatagaaggagtcaatatactccaggaacttgctcaaatagaacaactgcgtggtgatcctgaagacgttgttgtcaaaagccttctcgcagttgtcagacataacaccgatggtgtacatggcatatgccattgagaggaatgatcccaacgaataaatggacatgagaaggttgtaattggtgaaaacaaacttcatacgagactgaccttttggaccaagggggccaagagtgaacttcaagatgacaaatgcgatggacaagtaaagcacctcacagtgactggcatcactccagagttgggcataatcaactggttgggtaaaacttcctgcccaattgagactatttcattcaccacctccatggttagcgtgtcgtgtttttgttgtgctggaagaaccaaagggtggcgcaatgtgtgtagatatatatgtcgtgacccacaagtcacacaaacaagtatcgggaggagtggtgcacctctatgcggagaaaccttataccgctgtagaccaactggggcagaggtgtgagttgaagtcagctggaggagatgtgtgacagaagcacaagaagtgagattgtgagatgtatgtctagggggggaagttttgtgtcaaatatatgggaattattatcagcaccacgaaattatacgcctcatatgacccatttaggtggatagatcatggacactgttgacagctgcgaagaaaaagcgtattggggatgatccgaaattagtccggtaccgaggcgcaaatacgtaagacagccgatwaaatatatgcgagaaacaccaaagagactctagatgtttgtttggcacagttttgacttctgcgaaggccttacaccaccttgttgacccttgtcgcgggtcgggcaatatcggctgacagagttttacttgctcaataagatacgagctgcatagagttgaactacaggacaatattggggctggccacatgaagggcattgtttggaggtgtattgatggtgaaaacacgatatgaaatgacaacgccccctgttttattattattcttattattttgggtgcttctctatccatacaagcacctcctaacatgcttcataagtgacctcctcatcacaaggcctgaggtctcatttatccagtggcgccaagctaaactaaaactggtccgagtagactaaggcgaagagagaaggagagaagacagtttttttgtggccgcctgtgaacaatgaaaacgatgagggtgagatggagcaaaccatatggtttaaacagtcagaggagtacacgctgcttacataatggcgcaacgaccacatgtcccacagatacgcatcgattcgattcaaattaattaaaaggcgttgaaacagaatgagccagacagcaaggacaaggtggccaacagcaaggagtccaaaaagccctctattgacgagatccacgatgttattgctcatgaggtttccgagctcgatgctgggaagaagaagtgatttgtatataagaaataaatgagatatagtaaaggagtgcaagagaatggcaaggtggtcaaattctatattacttgcagtcactggttcctcgttgacatgaatgaagttaccgttggcatagctgatttaatatataactgtccaactaactctcacctagatataacccatgtgtgtgtttccaatcatcaatgcggccgcttactgagccttggcaccgggctgcttctcggccattcgagcgaactgggacaggtatcggagcaggatgacgagaccttcatggggcagagggtttcggtaggggaggttgtgcttctggcacagctgttccacctggtaggaaacggcagtgaggttgtgtcgaggcagggtgggccagagatggtgctcgatctggtagttcaggcctccaaagaaccagtcagtaatgatgcctcgtcgaatgttcatggtctcatggatctgacccacagagaagccatgtccgtcccagacggaatcaccgatcttctccagagggtagtggttcatgaagaccacgatggcaattccgaagccaccgacgagctcggaaacaaagaacaccagcatcgaggtcaggatggagggcataaagaagaggtggaacagggtcttgagagtccagtgcagagcgagtccaatggcctctttcttgtactgagatcggtagaactggttgtctcggtccttgagggatcgaacggtcagcacagactggaaacaccagatgaatcgcaggagaatacagatgaccaggaaatagtactgttggaactgaatgagctttcgggagatgggagaagctcgagtgacatcgtcctcggaccaggcgagcagaggcaggttatcaatgtcgggatcgtgaccctgaacgttggtagcagaatgatgggcgttgtgtctgtccttccaccaggtcacggagaagccctggagtccgttgccaaagaccagacccaggacgttattccagtttcggttcttgaaggtctggtggtggcagatgtcatgagacagccatcccatttgctggtagtgcataccgagcacgagagcaccaatgaagtacaggtggtactggaccagcatgaagaaggcaagcacgccaagacccagggtggtcaagatcttgtacgagtaccagaggggagaggcgtcaaacatgccagtggcgatcagctcttctcggagctttcggaaatcctcctgagcttcgttgacggcagcctggggaggcagctcggaagcctggttgatcttgggcattcgcttgagcttgtcgaaggcttcctgagagtgcataaccatgaaggcgtcagtagcatctcgtccctggtagttctcaatgatttcagctccaccagggtggaagttcacccaagcggagacgtcgtacacctttccgtcgatgacgaggggcagagcctgtcgagaagccttcaccatggccattgctgtagatatgtcttgtgtgtaagggggttggggtggttgtttgtgttcttgacttttgtgttagcaagggaagacgggcaaaaaagtgagtgtggttgggagggagagacgagccttatatataatgcttgtttgtgtttgtgcaagtggacgccgaaacgggcaggagccaaactaaacaaggcagacaatgcgagcttaattggattgcctgatgggcaggggttagggctcgatcaatgggggtgcgaagtgacaaaattgggaattaggttcgcaagcaaggctgacaagactttggcccaaacatttgtacgcggtggacaacaggagccacccatcgtctgtcacgggctagccggtcgtgcgtcctgtcaggctccacctaggctccatgccactccatacaatcccactagtgtaccgctaggccgcttttagctcccatctaagacccccccaaaacctccactgtacagtgcactgtactgtgtggcgatcaagggcaagggaaaaaaggcgcaaacatgcacgcatggaatgacgtaggtaaggcgttactagactgaaaagtggcacatttcggcgtgccaaagggtcctaggtgcgtttcgcgagctgggcgccaggccaagccgctccaaaacgcctctccgactccctccagcggcctccatatccccatccctctccacagcaatgttgttaagccttgcaaacgaaaaaatagaaaggctaataagcttccaatattgtggtgtacgctgcataacgcaacaatgagcgccaaacaacacacacacacagcacacagcagcattaaccacgatgtttaaacagtgtacgcagatcccgtcaacagttttatatatcgtagttacaaccatcaacactttttggtaagtgtaccattctatactccaactggtctgcaactgtacaagtagacatgttaatggtagttaataacatctacagcagaacctatggtaaagacattgcatttttacaggaagtatcgtcctacacgttgataaatccaaagatgcggaacttcttccacttttatcatcatcccctactcgtacactcgtactctttgttcgatcgcgattcatttctataaataatcttgtatgtacatgcggccgcttaagcaacgggcttgataacagcggggggggtgcccacgttgttgcggttgcggaagaacagaacacccttaccagcaccctcggcaccagcgctgggctcaacccactggcacatacgcgcactgcggtacatggcgcggatgaagccacgaggaccatcctggacatcagcccggtagtgcttgcccatgatgggcttaatggcctcggtggcctcgtccgcgttgtagaaggggatgctgctgacgtagtggtggaggacatgagtctcgatgatgccgtggagaaggtggcggccgatgaagcccatctcacggtcaatggtagcagcggcaccacggacgaagttccactcgtcgttggtgtagtggggaagggtagggtcggtgtgctggaggaaggtgatggcaacgagccagtggttaacccagaggtagggaacaaagtaccagatggccatgttgtagaaaccgaacttctgaacgaggaagtacagagcagtggccatcagaccgataccaatatcgctgaggacgatgagcttagcgtcactgttctcgtacagagggctgcggggatcgaagtggttaacaccaccgccgaggccgttatgcttgcccttgccgcgaccctcacgctggcgctcgtggtagttgtggccggtaacattggtgatgaggtagttgggccagccaacgagctgctgaaggacgagcatgagaagagtgaaagcgggggtctcctcagtaagatgagcgagctcgtgggtcatctttccgagacgagtagcctgctgctcgcgggttcggggaacgaagaccatgtcacgctccatgttgccagtggccttgtggtgctttcggtgggagatttgccagctgaagtaggggacaaggagggaagagtgaagaacccagccagtaatgtcgttgatgatgcgagaatcggagaaagcaccgtgaccgcactcatgggcaataacccagagaccagtaccgaaaagaccctgaagaacggtgtacacggcccacagaccagcgcgggcgggggtggaggggatatattcgggggtcacaaagttgtaccagatgctgaaagtggtagtcaggaggacaatgtcgcggaggatataaccgtatcccttgagagcggagcgcttgaagcagtgcttagggatggcattgtagatgtccttgatggtaaagtcgggaacctcgaactggttgccgtaggtgtcgagcatgacaccatactcggacttgggcttggcgatatcaacctcggacatggacgagagcgatgtggaagaggccgagtggcggggagagtctgaaggagagacggcggcagactcagaatccgtcacagtagttgaggtgacggtgcgtctaagcgcagggttctgcttgggcagagccgaagtggacgccatggttgtgaattagggtggtgagaatggttggttgtagggaagaatcaaaggccggtctcgggatccgtgggtatatatatatatatatatatatacgatccttcgttacctccctgttctcaaaactgtggtttttcgtttttcgttttttgctttttttgatttttttagggccaactaagcttccagatttcgctaatcacctttgtactaattacaagaaaggaagaagctgattagagttgggctttttatgcaactgtgctactccttatctctgatatgaaagtgtagacccaatcacatcatgtcatttagagttggtaatactgggaggatagataaggcacgaaaacgagccatagcagacatgctgggtgtagccaagcagaagaaagtagatgggagccaattgacgagcgagggagctacgccaatccgacatacgacacgctgagatcgtcttggccggggggtacctacagatgtccaagggtaagtgcttgactgtaattgtatgtctgaggacaaatatgtagtcagccgtataaagtcataccaggcaccagtgccatcatcgaaccactaactctctatgatacatgcctccggtattattgtaccatgcgtcgctttgttacatacgtatcttgcctttttctctcagaaactccagactttggctattggtcgagataagcccggaccatagtgagtctttcacactctacatttctcccttgctccaactatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggtgaaggcttctcgacaggctctgcccctcgtcatcgacggaaaggtgtacgacgtctccgcttgggtgaacttccaccctggtggagctgaaatcattgagaactaccagggacgagatgctactgacgccttcatggttatgcactctcaggaagccttcgacaagctcaagcgaatgcccaagatcaaccaggcttccgagctgcctccccaggctgccgtcaacgaagctcaggaggatttccgaaagctccgagaagagctgatcgccactggcatgtttgacgcctctcccctctggtactcgtacaagatcttgaccaccctgggtcttggcgtgcttgccttcttcatgctggtccagtaccacctgtacttcattggtgctctcgtgctcggtatgcactaccagcaaatgggatggctgtctcatgacatctgccaccaccagaccttcaagaaccgaaactggaataacgtcctgggtctggtctttggcaacggactccagggcttctccgtgacctggtggaaggacagacacaacgcccatcattctgctaccaacgttcagggtcacgatcccgacattgataacctgcctctgctcgcctggtccgaggacgatgtcactcgagcttctcccatctcccgaaagctcattcagttccaacagtactatttcctggtcatctgtattctcctgcgattcatctggtgtttccagtctgtgctgaccgttcgatccctcaaggaccgagacaaccagttctaccgatctcagtacaagaaagaggccattggactcgctctgcactggactctcaagaccctgttccacctcttctttatgccctccatcctgacctcgatgctggtgttctttgtttccgagctcgtcggtggcttcggaattgccatcgtggtcttcatgaaccactaccctctggagaagatcggtgattccgtctgggacggacatggcttctctgtgggtcagatccatgagaccatgaacattcgacgaggcatcattactgactggttctttggaggcctgaactaccagatcgagcaccatctctggcccaccctgcctcgacacaacctcactgccgtttcctaccaggtggaacagctgtgccagaagcacaacctcccctaccgaaaccctctgccccatgaaggtctcgtcatcctgctccgatacctgtcccagttcgctcgaatggccgagaagcagcccggtgccaaggctcagtaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgggtgaagcttccactggtcggcgtggtagtggggcagagtggggtcggtgtgctgcaggtaggtgatggccacgagccagtggttgacccacaggtaggggatcaggtagtagagggtgacggaagccaggccccatcggttgatggagtatgcgatgacggacatggtgataccaataccgacgttagagatccagatgttgaaccagtccttcttctcaaacagcggggcgttggggttgaagtggttgacagcccatttgttgagcttggggtacttctgtccggtaacgtaagacagcagatacagaggccatccaaacacctgctgggtgatgaggccgtagagggtcatgaggggagcgtcctcagcaagctcagaccagtcatgggcgcctcggttctccataaactcctttcggtccttgggcacaaacaccatatcacgggtgaggtgaccagtggacttgtggtgcatggagtgggtcagcttccaggcgtagtaagggaccagcatggaggagtgcagaacccatccggtgacgttgttgacggtgttagagtcggagaaagcagagtggccacactcgtgggcaagaacccacagaccggtgccaaacagaccctggacaatggagtacatggcccaggccacagctcggccggaagccgagggaataagaggcaggtacgcgtaggccatgtaggcaaaaacggcgataaagaagcaggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcttgaatctacaagtaggagggttggagtgattaagtgaaacttctttaacggctctatgccagttctattgatatccgaaacatcagtatgaaggtctgataagggtgacttcttcccacagattcgtatcagtacgagtacgagaccggtacttgtaacagtattgatactaaagggaaactacaacggttgtcagcgtaatgtgacttcgcccatgaacgcagacacgcagtgccgagtgcggtgatatcgcctactcgttacgtccatggactacacaacccctcggcttcgcttggcttagcctcgggctcggtgctgttcagttaaaacacaatcaaataacatttctactttttagaaggcaggccgtcaggagcaactccgactccattgacgtttctaaacatctgaatgccttccttaccttcaacaaactggcaggttcgggcgacagtgtaaagagacttgatgaagttggtgtcgtcgtgtcggtagtgcttgcccatgaccttcttgatcttctcagtggcgattcgggcgttgtagaagggaattcctttacctgcaggataacttcgtataatgtatgctatacgaagttatgatctctctcttgagcttttccataacaagttcttctgcctccaggaagtccatgggtggtttgatcatggttttggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgcgataacttcgtataatgtatgctatacgaagttatcgtacgatagttagtagacaacaat

SEQ ID NO: 325 - DNA, 1936 bp, Yarrowia lipolytica
  CDS (283)..(1539)
  ref <302>: TITLE: A  DELTA-12 DESATURASE GENE SUITABLE FOR ALTERING LEVELS OF POLYUNSATURATED FATTY ACIDS IN OLEAGINOUS YEASTS
  ref <310>: PATENT DOCUMENT NUMBER: U.S. 7,214,491
  ref <311>: PATENT FILING DATE: 2004-05-06
  ref <312>: PUBLICATION DATE: 2007-05-08
  ref <313>: RELEVANT RESIDUES IN SEQ ID NO: (1)..(1936)
  ref <302>: TITLE: A  DELTA-12 DESATURASE GENE SUITABLE FOR ALTERING LEVELS OF POLYUNSATURATED FATTY ACIDS IN OLEAGINOUS YEASTS
  ref <310>: PATENT DOCUMENT NUMBER: WO 2004/104167
  ref <311>: PATENT FILING DATE: 2004-05-07
  ref <312>: PUBLICATION DATE: 2004-12-02
  ref <313>: RELEVANT RESIDUES IN SEQ ID NO: (1)..(1936)
cgtagttatatacaagaggtagatgcgtgctggtgttagaggggctctcaggattaggaggaaaatttgacattggccctcaacatataacctcgggtgtgcctctgtttaccctcagcttttgcttgtccccaagtcagtcacgccaggccaaaaaggttggtggattgacagggagaaaaaaaaaagcctagtgggtttaaactcgaggtaagacattgaaatatataccggtcggcatcctgagtccctttctcgtattccaacagaccgaccatagaaatggattcgaccacgcagaccaacaccggcaccggcaaggtggccgtgcagccccccacggccttcattaagcccattgagaaggtgtccgagcccgtctacgacacctttggcaacgagttcactcctccagactactctatcaaggatattctggatgccattccccaggagtgctacaagcggtcctacgttaagtcctactcgtacgtggcccgagactgcttctttatcgccgtttttgcctacatggcctacgcgtacctgcctcttattccctcggcttccggccgagctgtggcctgggccatgtactccattgtccagggtctgtttggcaccggtctgtgggttcttgcccacgagtgtggccactctgctttctccgactctaacaccgtcaacaacgtcaccggatgggttctgcactcctccatgctggtcccttactacgcctggaagctgacccactccatgcaccacaagtccactggtcacctcacccgtgatatggtgtttgtgcccaaggaccgaaaggagtttatggagaaccgaggcgcccatgactggtctgagcttgctgaggacgctcccctcatgaccctctacggcctcatcacccagcaggtgtttggatggcctctgtatctgctgtcttacgttaccggacagaagtaccccaagctcaacaaatgggctgtcaaccacttcaaccccaacgccccgctgtttgagaagaaggactggttcaacatctggatctctaacgtcggtattggtatcaccatgtccgtcatcgcatactccatcaaccgatggggcctggcttccgtcaccctctactacctgatcccctacctgtgggtcaaccactggctcgtggccatcacctacctgcagcacaccgaccccactctgccccactaccacgccgaccagtggaacttcacccgaggagccgccgccaccatcgaccgagagtttggcttcatcggctccttctgcttccatgacatcatcgagacccacgttctgcaccactacgtgtctcgaattcccttctacaacgcccgaatcgccactgagaagatcaagaaggtcatgggcaagcactaccgacacgacgacaccaacttcatcaagtctctttacactgtcgcccgaacctgccagtttgttgaaggtaaggaaggcattcagatgtttagaaacgtcaatggagtcggagttgctcctgacggcctgccttctaaaaagtagagctagaaatgttatttgattgtgttttaactgaacagcaccgagcccgaggctaagccaagcgaagccgaggggttgtgtagtccatggacgtaacgagtaggcgatatcaccgcactcggcactgcgtgtctgcgttcatgggcgaagtcacattacgctgacaaccgttgtagtttccctttagtatcaatactgttacaagtaccggtctcgtactcgtactgatacgaatctgtgggaagaagtcacccttatcagaccttcatactgatgtttcggatatcaatagaactggcatagagccgttaaagaagtttcacttaatcactccaaccctcctacttgtagattcaagcagatcgataagatggatttgatggtcagtgctagc

SEQ ID NO: 326 - protein, 419 aa, Yarrowia lipolytica
MDSTTQTNTGTGKVAVQPPTAFIKPIEKVSEPVYDTFGNEFTPPDYSIKDILDAIPQECYKRSYVKSYSYVARDCFFIAVFAYMAYAYLPLIPSASGRAVAWAMYSIVQGLFGTGLWVLAHECGHSAFSDSNTVNNVTGWVLHSSMLVPYYAWKLTHSMHHKSTGHLTRDMVFVPKDRKEFMENRGAHDWSELAEDAPLMTLYGLITQQVFGWPLYLLSYVTGQKYPKLNKWAVNHFNPNAPLFEKKDWFNIWISNVGIGITMSVIAYSINRWGLASVTLYYLIPYLWVNHWLVAITYLQHTDPTLPHYHADQWNFTRGAAATIDREFGFIGSFCFHDIIETHVLHHYVSRIPFYNARIATEKIKKVMGKHYRHDDTNFIKSLYTVARTCQFVEGKEGIQMFRNVNGVGVAPDGLPSKK

SEQ ID NO: 327 - DNA, 1272 bp, Artificial Sequence
  mutant EgD8S-23 delta-8 desaturase
  CDS (2)..(1270)
catggtgaaggcttctcgacaggctctgcccctcgtcatcgacggaaaggtgtacgacgtctccgcttgggtgaacttccaccctggtggagctgaaatcattgagaactaccagggacgagatgctactgacgccttcatggttatgcactctcaggaagccttcgacaagctcaagcgaatgcccaagatcaaccaggcttccgagctgcctccccaggctgccgtcaacgaagctcaggaggatttccgaaagctccgagaagagctgatcgccactggcatgtttgacgcctctcccctctggtactcgtacaagatcttgaccaccctgggtcttggcgtgcttgccttcttcatgctggtccagtaccacctgtacttcattggtgctctcgtgctcggtatgcactaccagcaaatgggatggctgtctcatgacatctgccaccaccagaccttcaagaaccgaaactggaataacgtcctgggtctggtctttggcaacggactccagggcttctccgtgacctggtggaaggacagacacaacgcccatcattctgctaccaacgttcagggtcacgatcccgacattgataacctgcctctgctcgcctggtccgaggacgatgtcactcgagcttctcccatctcccgaaagctcattcagttccaacagtactatttcctggtcatctgtattctcctgcgattcatctggtgtttccagtctgtgctgaccgttcgatccctcaaggaccgagacaaccagttctaccgatctcagtacaagaaagaggccattggactcgctctgcactggactctcaagaccctgttccacctcttctttatgccctccatcctgacctcgatgctggtgttctttgtttccgagctcgtcggtggcttcggaattgccatcgtggtcttcatgaaccactaccctctggagaagatcggtgattccgtctgggacggacatggcttctctgtgggtcagatccatgagaccatgaacattcgacgaggcatcattactgactggttctttggaggcctgaactaccagatcgagcaccatctctggcccaccctgcctcgacacaacctcactgccgtttcctaccaggtggaacagctgtgccagaagcacaacctcccctaccgaaaccctctgccccatgaaggtctcgtcatcctgctccgatacctgtcccagttcgctcgaatggccgagaagcagcccggtgccaaggctcagtaagc

SEQ ID NO: 328 - protein, 422 aa, Artificial Sequence
  Synthetic Construct
MVKASRQALPLVIDGKVYDVSAWVNFHPGGAEIIENYQGRDATDAFMVMHSQEAFDKLKRMPKINQASELPPQAAVNEAQEDFRKLREELIATGMFDASPLWYSYKILTTLGLGVLAFFMLVQYHLYFIGALVLGMHYQQMGWLSHDICHHQTFKNRNWNNVLGLVFGNGLQGFSVTWWKDRHNAHHSATNVQGHDPDIDNLPLLAWSEDDVTRASPISRKLIQFQQYYFLVICILLRFIWCFQSVLTVRSLKDRDNQFYRSQYKKEAIGLALHWTLKTLFHLFFMPSILTSMLVFFVSELVGGFGIAIVVFMNHYPLEKIGDSVWDGHGFSVGQIHETMNIRRGIITDWFFGGLNYQIEHHLWPTLPRHNLTAVSYQVEQLCQKHNLPYRNPLPHEGLVILLRYLSQFARMAEKQPGAKAQ

SEQ ID NO: 329 - DNA, 777 bp, Euglena gracilis; identical to SEQ ID NO: 112
  CDS (1)..(777): delta-9 elongase
  ref <302>: TITLE: DELTA-9 ELONGASES AND THEIR USE IN MAKING POLYUNSATURATED FATTY ACIDS
  ref <310>: PATENT DOCUMENT NUMBER: WO 2007/061742
  ref <311>: PATENT FILING DATE: 2006-11-16
  ref <312>: PUBLICATION DATE: 2007-05-31
  ref <313>: RELEVANT RESIDUES IN SEQ ID NO: (1)..(777)
  ref <302>: TITLE: DELTA-9 ELONGASES AND THEIR USE IN MAKING POLYUNSATURATED FATTY ACIDS
  ref <310>: PATENT DOCUMENT NUMBER: US 2007-0117190-A1
  ref <311>: PATENT FILING DATE: 2006-11-16
  ref <312>: PUBLICATION DATE: 2007-05-24
  ref <313>: RELEVANT RESIDUES IN SEQ ID NO: (1)..(777)

SEQ ID NO: 330 - protein, 258 aa, Euglena gracilis; identical to SEQ ID NO: 319

SEQ ID NO: 331 - DNA, 13707 bp, Artificial Sequence
  Plasmid pZKSL-555R
aaacagtgtacgcagatctgcccatgatgggggctcccaccaccagcaatcagggccctgattacacacccacctgtaatgtcatgctgttcatcgtggttaatgctgctgtgtgctgtgtgtgtgtgttgtttggcgctcattgttgcgttatgcagcgtacaccacaatattggaagcttattagcctttctattttttcgtttgcaaggcttaacaacattgctgtggagagggatggggatatggaggccgctggagggagtcggagaggcgttttggagcggcttggcctggcgcccagctcgcgaaacgcacctaggaccctttggcacgccgaaatgtgccacttttcagtctagtaacgccttacctacgtcattccatgcgtgcatgtttgcgccttttttcccttgcccttgatcgccacacagtacagtgcactgtacagtggaggttttgggggggtcttagatgggagctaaaagcggcctagcggtacactagtgggattgtatggagtggcatggagcctaggtggagcctgacaggacgcacgaccggctagcccgtgacagacgatgggtggctcctgttgtccaccgcgtacaaatgtttgggccaaagtcttgtcagccttgcttgcgaacctaattcccaattttgtcacttcgcacccccattgatcgagccctaacccctgcccatcaggcaatccaattaagctcgcattgtctgccttgtttagtttggctcctgcccgtttcggcgtccacttgcacaaacacaaacaagcattatatataaggctcgtctctccctcccaaccacactcacttttttgcccgtcttcccttgctaacacaaaagtcaagaacacaaacaaccaccccaacccccttacacacaagacatatctacagcaatggccatggctctctcccttactaccgagcagctgctcgagcgacccgacctggttgccatcgacggcattctctacgatctggaaggtcttgccaaggtccatcccggaggcgacttgatcctcgcttctggtgcctccgatgcttctcctctgttctactccatgcacccttacgtcaagcccgagaactcgaagctgcttcaacagttcgtgcgaggcaagcacgaccgaacctccaaggacattgtctacacctacgactctccctttgcacaggacgtcaagcgaactatgcgagaggtcatgaaaggtcggaactggtatgccacacctggattctggctgcgaaccgttggcatcattgctgtcaccgccttttgcgagtggcactgggctactaccggaatggtgctgtggggtctcttgactggattcatgcacatgcagatcggcctgtccattcagcacgatgcctctcatggtgccatcagcaaaaagccctgggtcaacgctctctttgcctacggcatcgacgtcattggatcgtccagatggatctggctgcagtctcacatcatgcgacatcacacctacaccaatcagcatggtctcgacctggatgccgagtccgcagaaccattccttgtgttccacaactaccctgctgccaacactgctcgaaagtggtttcaccgattccaggcctggtacatgtacctcgtgcttggagcctacggcgtttcgctggtgtacaaccctctctacatcttccgaatgcagcacaacgacaccattcccgagtctgtcacagccatgcgagagaacggctttctgcgacggtaccgaacccttgcattcgttatgcgagctttcttcatctttcgaaccgccttcttgccctggtatctcactggaacctccctgctcatcaccattcctctggtgcccactgctaccggtgccttcctcaccttctttttcatcttgtctcacaacttcgatggctcggagcgaatccccgacaagaactgcaaggtcaagagctccgagaaggacgttgaagccgatcagatcgactggtacagagctcaggtggagacctcttccacctacggtggacccattgccatgttctttactggcggtctcaacttccagatcgagcatcacctctttcctcgaatgtcgtcttggcactatcccttcgtgcagcaagctgtccgagagtgttgcgaacgacacggagttcggtacgtcttctaccctaccattgtgggcaacatcatttccaccctcaagtacatgcacaaagtcggtgtggttcactgtgtcaaggacgctcaggattcctaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgctgtgttgttgtatgtggtgaagcttgacaatggatggtgtgtcgtatcaggctggggaacaattgtgcttaagtatgctgcagttgagtaagagtcatcgctccaccaaaataaagtttgccattagggttggagagagagatggtggctggaagaattaaatgacatcaagctgaggattgtgggtgtgcaataacacatgttaggggtgacctgtggctcgaaatctgataattattttgtaactttatgattattcttagattttttaatattcctctatataacacataagtagctgtcgtctagttgttcatagcctgactcctgcaatagattagtgcagagtgattttgtgcaattgagagccacggttgagtcaagtgactttgtgtgtgaagtcatcttacgtttcaagtctcacaggttactcaattggttggttgtctgccctttacagatatttacagtacctgagcgtaaagtcgttcatccacggaatgactgttcctgtcacgcagtcatgatcatggatgtggctggtcaggaaccattttggataggagacttagggattggactattattgaaaaaactgagccgaatatgatatagttctatttgaatgcagaacttctgatggtcaattcacttatttcaggcatatcggtcatggtggcagctgccacgatgttatctcgttggaaacctcggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcattccatagccacacctttgcctatggcttcacaaccgaaggcaattcgagaggtcgcgcttatggaatcgactcgtataaagctgaagggaaagggagacgttccgagcgctcagatgcaatagtcgtccagctaatgtggattcaaaaacaaccccaacagtaatcttgaaaatttgaacggatcaatctgaacactcttgctccaggtcattcttctaacgcacatccccagagtctagagggagttgtgttgtgaacatcctaataaacaatgcaatggattcgggatatcttctgtctcgccccctactcgatgtcgagtaaaccgatcaccaactaacaatactcctccgcgttctgccattgactctcaaacagacatcgctatcaacggaacagcatattttagcttcttaggacaataaatattgataatgccggctctccctcggtatattaagcaatccattcatacactcattcatcaggttaattttatatatataatttgtctattcaaacaccgtaaattactggtaccatcatctcctccttttcaaatacacgtctatttgcattaatgaaattactcgccaattcgcagaacgtgtttgtcgaacagagccttagctcgggtccagacaggagcagtgtctcgctgaggaagctgcaggagagttaattaactcacctgcaggattgagactatgaatggattcccgtgcccgtattactctactaatttgatcttggaacgcgaaaatacgtttctaggactccaaagaatctcaactcttgtccttactaaatatactacccatagttgatggtttacttgaacagagaggacatgttcacttgacccaaagtttctcgcatctcttggatatttgaacaacggcgtccactgaccgtcagttatccagtcacaaaacccccacattcatacattcccatgtacgtttacaaagttctcaattccatcgtgcaaatcaaaatcacatctattcattcatcatatataaacccatcatgtctactaacactcacaactccatagaaaacatcgactcagaacacacgctccatgcggccgcttaggaatcctgtgcgtccttcacgcagtggacgacacccaccttatgcatgtacttcagggtggagatgatgttgccgacgatggtagggtagaaaacatatcgcactccatgtcgttcgcaacactcccggaccgcctgctggacgaaggggtagtgccaagacgacatccggggaaagaggtggtgctcgatctggaaattgagaccgccagtgaagaacatggcgatggggccaccgtatgtggaggacgtctccacctgcgcccgataccagtcaatttggtcagcctcaacgtccttctcagatcgcttaaccttgcagttcttgtcggggatccgttcggagccatcaaaattgtgggacaaaatgaagaagaacgtcaagaaggcaccagttgcggtgggcaccagaggaatggtgatcagcaatgaggtcccagtgaggtaccagggcaagaatgcggtccggaagatgaagaaagctcgcatcacgaatgcaagtgtgcggtagcgccgcagaaagccattttcccgcatggccgtgacagactctgggatggtgtcattgtgctgcatccggaaaatgtagagcgggttgtacaccagcgataccccgtatgcccccagcacaaggtacatgtaccaagcctggaagcggtggaaccactttcgggcggtgtttgcggcggggtagttgtggaacaccaggaacggctctgccgactccgcatccaggtcgaggccgtgctggttggtgtaggtgtggtgccgcatgatgtgcgactgcagccaaatccaccgggacgatccgatgacgtcaatgccgtaggcgaagagggcgttgacccaaggcttcttgctgatggccccgtgggacgcatcatgctggatggataagccgatctgcatgtgcatgaatccagtcaacaggccccacagcaccatccccgtggtagcccagtgccactcgcaaaaggccgtcacggcgatgatcccaacggtgcgcagccagaagccaggggttgcgtaccagttcctccctttcatcacctcgcgcattgtccgcttaacgtcttgtgcgaagggagaatcatacgtgtagacaatgtccttcgaggtgcggtcatgcttccctcggacgaactgttgaagcaatttggagttctccggtttgacgtatggatgcattgaataaaagagaggggaggcatcagaggcaccagaagcgagaatcaaatctcctcctggatgaactttggcaagcccttcaaggtcgtagaggatgccatcaatcgcaaccaaatcagggcgttctaacagctgttctgtggtaagactgagagccatggagagctgggttagtttgtgtagagagtgtgtgttgctagcgactttcggattgtgtcattacacaaaacgcgtcgtctcgacactgatcttgtcgtggatactcacggctcggacatcgtcgccgacgatgacaccggactttcgcttaaggacgtcagtaacaggcattgtgtgatgtgtagtttagatttcgaatctgtggggaaagaaaggaaaaaagagactggcaaccgattgggagagccactgtttatatataccctagacaagccccccgcttgtaagatgttggtcaatgtaaaccagtattaaggttggcaagtgcaggagaagcaaggtgtgggtaccgagcaatggaaatgtgcggaaggcaaaaaaatgaggccacggcctattgtcggggctatatccagggggcgattgaagtacactaacatgacatgtgtccacagaccctcaatctggcctgatgagccaaatccatacgcgctttcgcagctctaaaggctataacaagtcacaccaccctgctcgacctcagcgccctcactttttgttaagacaaactgtacacgctgttccagcgttttctgcctgcacctggtgggacatttggtgcaacctaaagtgctcggaacctctgtggtgtccagatcagcgcagcagttccgaggtagttttgaggcccttagatgatgcaatggtgtcagtcgctggatcacgagtcttaatggcagtattcgttcttatttgtgccattgagccccgttatcctcgtatcttctaccccccatcccatccctttgttggtgcaaccctacccatttattgttgggtgcagcccaaccgacgtggagagcttggcttggccatataaaaaggcccccccctagtggcaatggcagaaagtcagctgtgagttgttgaatttgtcatctaggcggcctggccgtcttctccggggcaattggggctgttttttgggacacaaatacgccgccaacccggtctctcctgaattccgtcgtcgcctgagtcgacatcatttatttaccagttggccacaaacccttgacgatctcgtatgtcccctccgacatactcccggccggctggggtacgttcgatagcgctatcggcatcgacaaggtttgggtccctagccgataccgcactacctgagtcacaatcttcggaggtttagtcttccacatagcacgggcaaaagtgcgtatatatacaagagcgtttgccagccacagattttcactccacacaccacatcacacatacaaccacacacatccacaatggaacccgaaactaagaagaccaagactgactccaagaagattgttcttctcggcggcgacttctgtggccccgaggtgattgccgaggccgtcaaggtgctcaagtctgttgctgaggcctccggcaccgagtttgtgtttgaggaccgactcattggaggagctgccattgagaaggagggcgagcccatcaccgacgctactctcgacatctgccgaaaggctgactctattatgctcggtgctgtcggaggcgctgccaacaccgtatggaccactcccgacggacgaaccgacgtgcgacccgagcagggtctcctcaagctgcgaaaggacctgaacctgtacgccaacctgcgaccctgccagctgctgtcgcccaagctcgccgatctctcccccatccgaaacgttgagggcaccgacttcatcattgtccgagagctcgtcggaggtatctactttggagagcgaaaggaggatgacggatctggcgtcgcttccgacaccgagacctactccgttcctgaggttgagcgaattgcccgaatggccgccttcctggcccttcagcacaacccccctcttcccgtgtggtctcttgacaaggccaacgtgctggcctcctctcgactttggcgaaagactgtcactcgagtcctcaaggacgaactcccccagctcgagctcaaccaccagctgatcgactcggccgccatgatcctcatcaagcagccctccaagatgaatggtatcatcatcaccaccaacatgtttggcgatatcatctccgacgaggcctccgtcatccccggttctctgggtctgctgccctccgcctctctggcttctctgcccgacaccaacgaggcgttcggtctgtacgagccctgtcacggatctgcccccgatctcggcaagcagaaggtcaaccccattgccaccattctgtctgccgccatgatgctcaagttctctcttaacatgaagcccgccggtgacgctgttgaggctgccgtcaaggagtccgtcgaggctggtatcactaccgccgatatcggaggctcttcctccacctccgaggtcggagacttgttgccaacaaggtcaaggagctgctcaagaaggagtaagtcgtttctacgacgcattgatggaaggagcaaactgacgcgcctgcgggttggtctaccggcagggtccgctagtgtataagactctataaaaagggccctgccctgctaatgaaatgatgatttataatttaccggtgtagcaaccttgactagaagaagcagattgggtgtgtttgtagtggaggacagtggtacgttttggaaacagtcttcttgaaagtgtcttgtctacagtatattcactcataacctcaatagccaagggtgtagtcggtttattaaaggaagggagttgtggctgatgtggatatcgatagttggagcaagggagaaatgtagagtgtgaaagactcactatggtccgggcttatctcgaccaatagccaaagtctggagtttctgagagaaaaaggcaagatacgtatgtaacaaagcgacgcatggtacaataataccggaggcatgtatcatagagagttagtggttcgatgatggcactggtgcctggtatgactttatacggctgactacatatttgtcctcagacatacaattacagtcaagcacttacccttggacatctgtaggtaccccccggccaagacgatctcagcgtgtcgtatgtcggattggcgtagctccctcgctcgtcaattggctcccatctactttcttctgcttggctacacccagcatgtctgctatggctcgttttcgtgccttatctatcctcccagtattaccaactctaaatgacatgatgtgattgggtctacactttcatatcagagataaggagtagcacagttgcataaaaagcccaactctaatcagcttcttcctttcttgtaattagtacaaaggtgattagcgaaatctggaagcttagttggccctaaaaaaatcaaaaaaagcaaaaaacgaaaaacgaaaaaccacagttttgagaacagggaggtaacgaaggatcgtatatatatatatatatatatatacccacggatcccgagaccggcctttgattcttccctacaaccaaccattctcaccaccctaattcacaaccatggctcccgacgccgacaagctgcgacagcgaaaggctcagtccatccaggacactgccgattctcaggctaccgagctcaagattggcaccctgaagggtctccaaggcaccgagatcgtcattgatggcgacatctacgacatcaaagacttcgatcaccctggaggcgaatccatcatgacctttggtggcaacgacgttactgccacctacaagatgattcatccctaccactcgaagcatcacctggagaagatgaaaaaggtcggtcgagtgcccgactacacctccgagtacaagttcgatactcccttcgaacgagagatcaaacaggaggtcttcaagattgtgcgaagaggtcgagagtttggaacacctggctacttctttcgagccttctgctacatcggtctcttcttttacctgcagtatctctgggttaccactcctaccactttcgcccttgctatcttctacggtgtgtctcaggccttcattggcctgaacgtccagcacgacgccaaccacggagctgcctccaaaaagccctggatcaacaatttgctcggcctgggtgccgactttatcggaggctccaagtggctctggatgaaccagcactggacccatcacacttacaccaaccatcacgagaaggatcccgacgccctgggtgcagagcctatgctgctcttcaacgactatcccttgggtcaccccaagcgaaccctcattcatcacttccaagccttctactatctgtttgtccttgctggctactgggtgtcttcggtgttcaaccctcagatcctggacctccagcaccgaggtgcccaggctgtcggcatgaagatggagaacgactacattgccaagtctcgaaagtacgctatcttcctgcgactcctgtacatctacaccaacattgtggctcccatccagaaccaaggcttttcgctcaccgtcgttgctcacattcttactatgggtgtcgcctccagcctgaccctcgctactctgttcgccctctcccacaacttcgagaacgcagatcgggatcccacctacgaggctcgaaagggaggcgagcctgtctgttggttcaagtcgcaggtggaaacctcctctacttacggtggcttcatttccggttgccttacaggcggactcaactttcaggtcgagcatcacctgtttcctcgaatgtcctctgcctggtacccctacatcgctcctaccgttcgagaggtctgcaaaaagcacggcgtcaagtacgcctactatccctgggtgtggcagaacctcatctcgaccgtcaagtacctgcatcagtccggaactggctcgaactggaagaacggtgccaatccctactctggcaagctgtaagcggccgcatgtacatacaagattatttatagaaatgaatcgcgatcgaacaaagagtacgagtgtacgagtaggggatgatgataaaagtggaagaagttccgcatctttggatttatcaacgtgtaggacgatacttcctgtaaaaatgcaatgtctttaccataggttctgctgtagatgttattaactaccattaacatgtctacttgtacagttgcagaccagttggagtatagaatggtacacttaccaaaaagtgttgatggttgtaactacgatatataaaactgttgacgggatctgcgtacactgttt

SEQ ID NO: 332 - DNA, 1350 bp, Euglena gracilis
  CDS (1)..(1350): synthetic delta-5 desaturase (codon-optimized for Yarrowia lipolytica)
atggctctctcccttactaccgagcagctgctcgagcgacccgacctggttgccatcgacggcattctctacgatctggaaggtcttgccaaggtccatcccggaggcgacttgatcctcgcttctggtgcctccgatgcttctcctctgttctactccatgcacccttacgtcaagcccgagaactcgaagctgcttcaacagttcgtgcgaggcaagcacgaccgaacctccaaggacattgtctacacctacgactctccctttgcacaggacgtcaagcgaactatgcgagaggtcatgaaaggtcggaactggtatgccacacctggattctggctgcgaaccgttggcatcattgctgtcaccgccttttgcgagtggcactgggctactaccggaatggtgctgtggggtctcttgactggattcatgcacatgcagatcggcctgtccattcagcacgatgcctctcatggtgccatcagcaaaaagccctgggtcaacgctctctttgcctacggcatcgacgtcattggatcgtccagatggatctggctgcagtctcacatcatgcgacatcacacctacaccaatcagcatggtctcgacctggatgccgagtccgcagaaccattccttgtgttccacaactaccctgctgccaacactgctcgaaagtggtttcaccgattccaggcctggtacatgtacctcgtgcttggagcctacggcgtttcgctggtgtacaaccctctctacatcttccgaatgcagcacaacgacaccattcccgagtctgtcacagccatgcgagagaacggctttctgcgacggtaccgaacccttgcattcgttatgcgagctttcttcatctttcgaaccgccttcttgccctggtatctcactggaacctccctgctcatcaccattcctctggtgcccactgctaccggtgccttcctcaccttctttttcatcttgtctcacaacttcgatggctcggagcgaatccccgacaagaactgcaaggtcaagagctccgagaaggacgttgaagccgatcagatcgactggtacagagctcaggtggagacctcttccacctacggtggacccattgccatgttctttactggcggtctcaacttccagatcgagcatcacctctttcctcgaatgtcgtcttggcactatcccttcgtgcagcaagctgtccgagagtgttgcgaacgacacggagttcggtacgtcttctaccctaccattgtgggcaacatcatttccaccctcaagtacatgcacaaagtcggtgtggttcactgtgtcaaggacgctcaggattcctaa

SEQ ID NO: 333 - protein, 449 aa, Euglena gracilis
MALSLTTEQLLERPDLVAIDGILYDLEGLAKVHPGGDLILASGASDASPLFYSMHPYVKPENSKLLQQFVRGKHDRTSKDIVYTYDSPFAQDVKRTMREVMKGRNWYATPGFWLRTVGIIAVTAFCEWHWATTGMVLWGLLTGFMHMQIGLSIQHDASHGAISKKPWVNALFAYGIDVIGSSRWIWLQSHIMRHHTYTNQHGLDLDAESAEPFLVFHNYPAANTARKWFHRFQAWYMYLVLGAYGVSLVYNPLYIFRMQHNDTIPESVTAMRENGFLRRYRTLAFVMRAFFIFRTAFLPWYLTGTSLLITIPLVPTATGAFLTFFFILSHNFDGSERIPDKNCKVKSSEKDVEADQIDWYRAQVETSSTYGGPIAMFFTGGLNFQIEHHLFPRMSSWHYPFVQQAVRECCERHGVRYVFYPTIVGNIISTLKYMHKVGVVHCVKDAQDS

SEQ ID NO: 334 - DNA, 1392 bp, Peridinium sp. CCMP626
  CDS (1)..(1392): synthetic delta-5 desaturase (codon-optimized for Yarrowia lipolytica)
atggctcccgacgccgacaagctgcgacagcgaaaggctcagtccatccaggacactgccgattctcaggctaccgagctcaagattggcaccctgaagggtctccaaggcaccgagatcgtcattgatggcgacatctacgacatcaaagacttcgatcaccctggaggcgaatccatcatgacctttggtggcaacgacgttactgccacctacaagatgattcatccctaccactcgaagcatcacctggagaagatgaaaaaggtcggtcgagtgcccgactacacctccgagtacaagttcgatactcccttcgaacgagagatcaaacaggaggtcttcaagattgtgcgaagaggtcgagagtttggaacacctggctacttctttcgagccttctgctacatcggtctcttcttttacctgcagtatctctgggttaccactcctaccactttcgcccttgctatcttctacggtgtgtctcaggccttcattggcctgaacgtccagcacgacgccaaccacggagctgcctccaaaaagccctggatcaacaatttgctcggcctgggtgccgactttatcggaggctccaagtggctctggatgaaccagcactggacccatcacacttacaccaaccatcacgagaaggatcccgacgccctgggtgcagagcctatgctgctcttcaacgactatcccttgggtcaccccaagcgaaccctcattcatcacttccaagccttctactatctgtttgtccttgctggctactgggtgtcttcggtgttcaaccctcagatcctggacctccagcaccgaggtgcccaggctgtcggcatgaagatggagaacgactacattgccaagtctcgaaagtacgctatcttcctgcgactcctgtacatctacaccaacattgtggctcccatccagaaccaaggcttttcgctcaccgtcgttgctcacattcttactatgggtgtcgcctccagcctgaccctcgctactctgttcgccctctcccacaacttcgagaacgcagatcgggatcccacctacgaggctcgaaagggaggcgagcctgtctgttggttcaagtcgcaggtggaaacctcctctacttacggtggcttcatttccggttgccttacaggcggactcaactttcaggtcgagcatcacctgtttcctcgaatgtcctctgcctggtacccctacatcgctcctaccgttcgagaggtctgcaaaaagcacggcgtcaagtacgcctactatccctgggtgtggcagaacctcatctcgaccgtcaagtacctgcatcagtccggaactggctcgaactggaagaacggtgccaatccctactctggcaagctgtaa

SEQ ID NO: 335 - protein, 463 aa, Peridinium sp. CCMP626
MAPDADKLRQRKAQSIQDTADSQATELKIGTLKGLQGTEIVIDGDIYDIKDFDHPGGESIMTFGGNDVTATYKMIHPYHSKHHLEKMKKVGRVPDYTSEYKFDTPFEREIKQEVFKIVRRGREFGTPGYFFRAFCYIGLFFYLQYLWVTTPTTFALAIFYGVSQAFIGLNVQHDANHGAASKKPWINNLLGLGADFIGGSKWLWMNQHWTHHTYTNHHEKDPDALGAEPMLLFNDYPLGHPKRTLIHHFQAFYYLFVLAGYWVSSVFNPQILDLQHRGAQAVGMKMENDYIAKSRKYAIFLRLLYIYTNIVAPIQNQGFSLTVVAHILTMGVASSLTLATLFALSHNFENADRDPTYEARKGGEPVCWFKSQVETSSTYGGFISGCLTGGLNFQVEHHLFPRMSSAWYPYIAPTVREVCKKHGVKYAYYPWVWQNLISTVKYLHQSGTGSNWKNGANPYSGKL

SEQ ID NO: 336 - DNA, 1350 bp, Euglena gracilis
  CDS (1)..(1350): delta-5 desaturase
atggctctcagtcttaccacagaacagctgttagaacgccctgatttggttgcgattgatggcatcctctacgaccttgaagggcttgccaaagttcatccaggaggagatttgattctcgcttctggtgcctctgatgcctcccctctcttttattcaatgcatccatacgtcaaaccggagaattccaaattgcttcaacagttcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgttgactggattcatgcacatgcagatcggcttatccatccagcatgatgcgtcccacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaagcttggtacatgtaccttgtgctgggggcatacggggtatcgctggtgtacaacccgctctacattttccggatgcagcacaatgacaccatcccagagtctgtcacggccatgcgggagaatggctttctgcggcgctaccgcacacttgcattcgtgatgcgagctttcttcatcttccggaccgcattcttgccctggtacctcactgggacctcattgctgatcaccattcctctggtgcccactgcaactggtgccttcttgacgttcttcttcattttgtcccacaattttgatggctccgaacggatccccgacaagaactgcaaggttaagagctctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgccatggagtgcgatatgttttctaccctaccatcgtcggcaacatcatctccaccctgaagtacatgcataaggtgggtgtcgtccactgcgtgaaggacgcacaggattcctga

SEQ ID NO: 337 - protein, 449 aa, Euglena gracilis; identical to SEQ ID NO: 333

SEQ ID NO: 338 - DNA, 13066 bp, Artificial Sequence
  Plasmid pZP3-Pa777U
tctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcgcgccaccaatcacaattctgaaaagcacatcttgatctcctcattgcggggagtccaacggtggtcttattcccccgaatttcccgctcaatctcgttccagaccgacccggacacagtgcttaacgccgttccgaaactctaccgcagatatgctccaacggactgggctgcatagatgtgatcctcggcttggagaaatggataaaagccggccaaaaaaaaagcggaaaaaagcggaaaaaaagagaaaaaaaatcgcaaaatttgaaaaatagggggaaaagacgcaaaaacgcaaggaggggggagtatatgacactgataagcaagctcacaacggttcctcttatttttttcctcatcttctgcctaggttcccaaaatcccagatgcttctctccagtgccaaaagtaagtaccccacaggttttcggccgaaaattccacgtgcagcaacgtcgtgtggggtgttaaaatgtggggggggggaaccaggacaagaggctcttgtgggagccgaatgagagcacaaagcgggcgggtgtgataagggcatttttgcccattttcccttctcctgtctctccgacggtgatggcgttgtgcgtcctctatttctttttatttctttttgttttatttctctgactaccgatttggtttgatttcctcaaccccacacaaataagctcgggccgaggaatatatatatacacggacacagtcgccctgtggacaacacgtcactacctctacgatacacaccgtacgttgtgtggaagcttgtgagcggataacaatttcacacaggaaacagctatgaccatgattacgccaagctcgaaattaaccctcactaaagggaacaaaagctggagctccaccgcggacacaatatctggtcaaatttcagtttcgttacatttaaattccttcacttcaagttcattcttcatctgcttctgttttactttgacaggcaaatgaagacatggtacgacttgatggaggccaagaacgccatttcaccccgagacaccgaagtgcctgaaatcctggctgcccccattgataacatcggaaactacggtattccggaaagtgtatatagaacctttccccagcttgtgtctgtggatatggatggtgtaatcccctttgagtactcgtcttggcttctctccgagcagtatgaggctctctaatctagcgcatttaatatctcaatgtatttatatatttatcttctcatgcggccgcttagttggctttggtcttggcagccttggcctccttgagggtaaacatcttggcatccttgtcgaccacgccgtacttggcgtacataagaccaattcggatgaaggtgggaatgatgggagaagccgactttcgcaccagttcgggaaaggcctgagcgaaggcagcagtggcctcgttgagcttgtagtgaggaatgatgggaaacagatggtggatctgatgtgtaccaatgttgtgggacaggttgtcgatgagggctccgtagcttcggtccacagaggacaagttgcccttgacataggtccactccgaatcggcgtaccagggagtttcctcgtcgttgtgatggaggaaggtagtgacaaccagcatggtggcgaatccaaagagaggtgcgaagtaatacagagccatggtcttgaggccgtagacgtaggtaaggtaggcgtacagaccagcaaaggccacgagagagccgagggaaatgatgacggcagacattcttcgcaggtagagaggctcccagggattgaagtggttgacctttcggggaggaaatccagcaacgaggtaggcaaaccaagccgaaccaagggagatgaccatgtgtcgggacaggggatgagagtcggcttctcgctgagggtagaagatctcatccttgtcgatgttgccggtgttcttgtgatggtgtcgatggctgatcttccacgactcgtagggagtcagaatgatggagtgaatgagtgtgccaacagagaagttgagcaggtgggatcgcgagaaggcaccatgtccacagtcgtgaccgatggtaaagaatccccagaacacgataccctggagcagaatgtagccagtgcaaaggacggcatcgagcagtgcaaactcctgcacgatagcaagggctcgagcatagtacagtccgagagcaagggaaccggcaatgcccagagctcgcacggtatagtagagggaccagggaacagaggcttcgaagcagtgggcaggcagggatcgcttgatctcggtgagagtagggaactcgtagggagcggcaacggtagaggaagccatggttgtgaattagggtggtgagaatggttggttgtagggaagaatcaaaggccggtctcgggatccgtgggtatatatatatatatatatatatacgatccttcgttacctccctgttctcaaaactgtggtttttcgtttttcgttttttgctttttttgatttttttagggccaactaagcttccagatttcgctaatcacctttgtactaattacaagaaaggaagaagctgattagagttgggctttttatgcaactgtgctactccttatctctgatatgaaagtgtagacccaatcacatcatgtcatttagagttggtaatactgggaggatagataaggcacgaaaacgagccatagcagacatgctgggtgtagccaagcagaagaaagtagatgggagccaattgacgagcgagggagctacgccaatccgacatacgacacgctgagatcgtcttggccggggggtacctacagatgtccaagggtaagtgcttgactgtaattgtatgtctgaggacaaatatgtagtcagccgtataaagtcataccaggcaccagtgccatcatcgaaccactaactctctatgatacatgcctccggtattattgtaccatgcgtcgctttgttacatacgtatcttgcctttttctctcagaaactccagactttggctattggtcgagataagcccggaccatagtgagtctttcacactctacatttctcccttgctccaactatcgattgttgtctactaactatcgtacgataacttcgtatagcatacattatacgaagttatcgcgtcgacgagtatctgtctgactcgtcattgccgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagctaacgtccacaagtccgcctttgccgctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtacccggaaccggaatcattgctggcctgcgagctggtgccgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgacttattctcaactacatccccagtcacaataccaccactgcactaccactacaccaaaaccatgatcaaaccacccatggacttcctggaggcagaagaacttgttatggaaaagctcaagagagagatcataacttcgtatagcatacattatacgaagttatcctgcaggtaaaggaattcatgctgttcatcgtggttaatgctgctgtgtgctgtgtgtgtgtgttgtttggcgctcattgttgcgttatgcagcgtacaccacaatattggaagcttattagcctttctattttttcgtttgcaaggcttaacaacattgctgtggagagggatggggatatggaggccgctggagggagtcggagaggcgttttggagcggcttggcctggcgcccagctcgcgaaacgcacctaggaccctttggcacgccgaaatgtgccacttttcagtctagtaacgccttacctacgtcattccatgcgtgcatgtttgcgccttttttcccttgcccttgatcgccacacagtacagtgcactgtacagtggaggttttgggggggtcttagatgggagctaaaagcggcctagcggtacactagtgggattgtatggagtggcatggagcctaggtggagcctgacaggacgcacgaccggctagcccgtgacagacgatgggtggctcctgttgtccaccgcgtacaaatgtttgggccaaagtcttgtcagccttgcttgcgaacctaattcccaattttgtcacttcgcacccccattgatcgagccctaacccctgcccatcaggcaatccaattaagctcgcattgtctgccttgtttagtttggctcctgcccgtttcggcgtccacttgcacaaacacaaacaagcattatatataaggctcgtctctccctcccaaccacactcacttttttgcccgtcttcccttgctaacacaaaagtcaagaacacaaacaaccaccccaacccccttacacacaagacatatctacagcaatggccatggcttcttccactgttgctgcgccgtacgagttcccgacgctgacggagatcaagcgctcgctgccagcgcactgctttgaggcctcggtcccgtggtcgctctactacaccgtgcgcgcgctgggcatcgccggctcgctcgcgctcggcctctactacgcgcgcgcgctcgcgatcgtgcaggagtttgccctgctggatgcggtgctctgcacggggtacattctgctgcagggcatcgtattctgggggttcttcaccatcggccatgactgcggccacggcgcgttctcgcgttcgcacctgctcaacttcagcgtcggcacgctcattcactcgatcatcctcacgccgtacgagtcatggaagatctcgcaccgccaccaccacaagaacacgggcaacatcgacaaggacgagattttctacccgcagcgcgaggccgactcgcacccactgtcccgacacatggtgatctcgctcggctcggcctggttcgcgtacctcgttgcgggcttccctcctcgcaaggtgaaccacttcaacccttgggaaccgttgtacctgcgccgcatgtctgccgtcatcatctcactcggctcgctcgtggcgttcgcgggcttgtatgcgtatctcacctacgtctatggccttaagaccatggcgctgtactacttcgcccctctctttgggttcgccacgatgctcgtggtcactacctttttgcaccacaatgacgaggaaacgccatggtacgccgactcggagtggacgtacgtcaagggcaacctctcgtccgtggaccgctcgtacggcgcgctcatcgacaacctgagccacaacatcggcacgcaccagatccaccacctgtttccgatcatcccgcactacaagctgaacgaggcgacggcagcgttcgcgcaggcgttcccggagctcgtgcgcaagagcgcgtcgccgatcatcccgacgttcatccgcatcgggctcatgtacgccaagtacggcgtcgtggacaaggacgccaagatgtttacgctcaaggaggccaaggccgccaagaccaaggccaactaggcggccgcattgatgattggaaacacacacatgggttatatctaggtgagagttagttggacagttatatattaaatcagctatgccaacggtaacttcattcatgtcaacgaggaaccagtgactgcaagtaatatagaatttgaccaccttgccattctcttgcactcctttactatatctcatttatttcttatatacaaatcacttcttcttcccagcatcgagctcggaaacctcatgagcaataacatcgtggatctcgtcaatagagggctttttggactccttgctgttggccaccttgtccttgctgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggcttcttccactgttgctgcgccgtacgagttcccgacgctgacggagatcaagcgctcgctgccagcgcactgctttgaggcctcggtcccgtggtcgctctactacaccgtgcgcgcgctgggcatcgccggctcgctcgcgctcggcctctactacgcgcgcgcgctcgcgatcgtgcaggagtttgccctgctggatgcggtgctctgcacggggtacattctgctgcagggcatcgtattctgggggttcttcaccatcggccatgactgcggccacggcgcgttctcgcgttcgcacctgctcaacttcagcgtcggcacgctcattcactcgatcatcctcacgccgtacgagtcatggaagatctcgcaccgccaccaccacaagaacacgggcaacatcgacaaggacgagattttctacccgcagcgcgaggccgactcgcacccactgtcccgacacatggtgatctcgctcggctcggcctggttcgcgtacctcgttgcgggcttccctcctcgcaaggtgaaccacttcaacccttgggaaccgttgtacctgcgccgcatgtctgccgtcatcatctcactcggctcgctcgtggcgttcgcgggcttgtatgcgtatctcacctacgtctatggccttaagaccatggcgctgtactacttcgcccctctctttgggttcgccacgatgctcgtggtcactacctttttgcaccacaatgacgaggaaacgccatggtacgccgactcggagtggacgtacgtcaagggcaacctctcgtccgtggaccgctcgtacggcgcgctcatcgacaacctgagccacaacatcggcacgcaccagatccaccacctgtttccgatcatcccgcactacaagctgaacgaggcgacggcagcgttcgcgcaggcgttcccggagctcgtgcgcaagagcgcgtcgccgatcatcccgacgttcatccgcatcgggctcatgtacgccaagtacggcgtcgtggacaaggacgccaagatgtttacgctcaaggaggccaaggccgccaagaccaaggccaactaggcggccgcatggagcgtgtgttctgagtcgatgttttctatggagttgtgagtgttagtagacatgatgggtttatatatgatgaatgaatagatgtgattttgatttgcacgatggaattgagaactttgtaaacgtacatgggaatgtatgaatgtgggggttttgtgactggataactgacggtcagtggacgccgttgttcaaatatccaagagatgcgagaaactttgggtcaagtgaacatgtcctctctgttcaagtaaaccatcaactatgggtagtatatttagtaaggacaagagttgagattctttggagtcctagaaacgtattttcgcgttccaagatcaaattagtagagtaatacgggcacgggaatccattcatagtctcaatcctgcaggtgagttaattaagatgacgacatttgcgagctggacgaggaatagatggagcgtgtgttctgagtcgatgttttctatggagttgtgagtgttagtagacatgatgggtttatatatgatgaatgaatagatgtgattttgatttgcacgatggaattgagaactttgtaaacgtacatgggaatgtatgaatgtgggggttttgtgactggataactgacggtcagtggacgccgttgttcaaatatccaagagatgcgagaaactttgggtcaagtgaacatgtcctctctgttcaagtaaaccatcaactatgggtagtatatttagtaaggacaagagttgagattctttggagtcctagaaacgtattttcgcgttccaagatcaaattagtagagtaatacgggcacgggaatccattcatagtctcaattttcccataggtgtgctacaaggtgttgagatgtggtacagtaccaccatgattcgaggtaaagagcccagaagtcattgatgaggtcaagaaatacacagatctacagctcaatacaatgaatatcttctttcatattcttcaggtgacaccaagggtgtctattttccccagaaatgcgtgaaaaggcgcgtgtgtagcgtggagtatgggttcggttggcgtatccttcatatatcgacgaaatagtagggcaagagatgacaaaaagtatctatatgtagacagcgtagaatatggatttgattggtataaattcatttattgcgtgtctcacaaatactctcgataagttggggttaaactggagatggaacaatgtcgatatctcgacgcatgcgacgtcgggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaacccta

SEQ ID NO: 339 - DNA, 1080 bp, Pythium aphanidermatum
  CDS (1)..(1080): synthetic delta-17 desaturase (codon-optimized for Yarrowia lipolytica)
atggcttcctctaccgttgccgctccctacgagttccctactctcaccgagatcaagcgatccctgcctgcccactgcttcgaagcctctgttccctggtccctctactataccgtgcgagctctgggcattgccggttcccttgctctcggactgtactatgctcgagcccttgctatcgtgcaggagtttgcactgctcgatgccgtcctttgcactggctacattctgctccagggtatcgtgttctggggattctttaccatcggtcacgactgtggacatggtgccttctcgcgatcccacctgctcaacttctctgttggcacactcattcactccatcattctgactccctacgagtcgtggaagatcagccatcgacaccatcacaagaacaccggcaacatcgacaaggatgagatcttctaccctcagcgagaagccgactctcatcccctgtcccgacacatggtcatctcccttggttcggcttggtttgcctacctcgttgctggatttcctccccgaaaggtcaaccacttcaatccctgggagcctctctacctgcgaagaatgtctgccgtcatcatttccctcggctctctcgtggcctttgctggtctgtacgcctaccttacctacgtctacggcctcaagaccatggctctgtattacttcgcacctctctttggattcgccaccatgctggttgtcactaccttcctccatcacaacgacgaggaaactccctggtacgccgattcggagtggacctatgtcaagggcaacttgtcctctgtggaccgaagctacggagccctcatcgacaacctgtcccacaacattggtacacatcagatccaccatctgtttcccatcattcctcactacaagctcaacgaggccactgctgccttcgctcaggcctttcccgaactggtgcgaaagtcggcttctcccatcattcccaccttcatccgaattggtcttatgtacgccaagtacggcgtggtcgacaaggatgccaagatgtttaccctcaaggaggccaaggctgccaagaccaaagccaactaa

SEQ ID NO: 340 - protein, 359 aa, Pythium aphanidermatum
MASSTVAAPYEFPTLTEIKRSLPAHCFEASVPWSLYYTVRALGIAGSLALGLYYARALAIVQEFALLDAVLCTGYILLQGIVFWGFFTIGHDCGHGAFSRSHLLNFSVGTLIHSIILTPYESWKISHRHHHKNTGNIDKDEIFYPQREADSHPLSRHMVISLGSAWFAYLVAGFPPRKVNHFNPWEPLYLRRMSAVIISLGSLVAFAGLYAYLTYVYGLKTMALYYFAPLFGFATMLVVTTFLHHNDEETPWYADSEWTYVKGNLSSVDRSYGALIDNLSHNIGTHQIHHLFPIIPHYKLNEATAAFAQAFPELVRKSASPIIPTFIRIGLMYAKYGVVDKDAKMFTLKEAKAAKTKAN

SEQ ID NO: 341 - DNA, 1080 bp, Pythium aphanidermatum
  CDS (1)..(1080): delta-17 desaturase
atggcttcttccactgttgctgcgccgtacgagttcccgacgctgacggagatcaagcgctcgctgccagcgcactgctttgaggcctcggtcccgtggtcgctctactacaccgtgcgcgcgctgggcatcgccggctcgctcgcgctcggcctctactacgcgcgcgcgctcgcgatcgtgcaggagtttgccctgctggatgcggtgctctgcacggggtacattctgctgcagggcatcgtattctgggggttcttcaccatcggccatgactgcggccacggcgcgttctcgcgttcgcacctgctcaacttcagcgtcggcacgctcattcactcgatcatcctcacgccgtacgagtcatggaagatctcgcaccgccaccaccacaagaacacgggcaacatcgacaaggacgagattttctacccgcagcgcgaggccgactcgcacccactgtcccgacacatggtgatctcgctcggctcggcctggttcgcgtacctcgttgcgggcttccctcctcgcaaggtgaaccacttcaacccttgggaaccgttgtacctgcgccgcatgtctgccgtcatcatctcactcggctcgctcgtggcgttcgcgggcttgtatgcgtatctcacctacgtctatggccttaagaccatggcgctgtactacttcgcccctctctttgggttcgccacgatgctcgtggtcactacctttttgcaccacaatgacgaggaaacgccatggtacgccgactcggagtggacgtacgtcaagggcaacctctcgtccgtggaccgctcgtacggcgcgctcatcgacaacctgagccacaacatcggcacgcaccagatccaccacctgtttccgatcatcccgcactacaagctgaacgaggcgacggcagcgttcgcgcaggcgttcccggagctcgtgcgcaagagcgcgtcgccgatcatcccgacgttcatccgcatcgggctcatgtacgccaagtacggcgtcgtggacaaggacgccaagatgtttacgctcaaggaggccaaggccgccaagaccaaggccaactag

SEQ ID NO: 342 - protein, 359 aa, Pythium aphanidermatum; identical to SEQ ID NO: 340

SEQ ID NO: 343 - DNA, 9570 bp, Artificial Sequence
  Plasmid pY117
ggccgccaccgcggcccgagattccggcctcttcggccgccaagcgacccgggtggacgtctagaggtacctagcaattaacagatagtttgccggtgataattctcttaacctcccacactcctttgacataacgatttatgtaacgaaactgaaatttgaccagatattgtgtccgcggtggagctccagcttttgttccctttagtgagggtttaaacgagcttggcgtaatcatggtcatagctgtttcctgtgtgaaattgttatccgctcacaattccacacaacgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaaccgatttcgacagtaattaattaattccctagtcccagtgtacacccgccgatatcgcttaccctgcagccggattaaggttggcaatttttcacgtccttgtctccgcaattactcaccgggtggtttataagattgcaagcgtcttgatttgtctctgtatactaacatgcaatcgcgactcgcccgacgggccactaacctggccagaatctccagatccaagtattctcttggtctgcgatatgtttccaacacaaaagcccctgctgcccagccggcaactgctgagtgagtattccttgccataaacgacccagaaccactgtatagtgtttggaagcactagtcagaagaccagcgaaaacaggtggaaaaaactgagacgaaaagcaacgaccagaaatgtaatgtgtggaaaagcgacacacacagagcagataaagaggtgacaaataacgacaaatgaaatatcagtatcttcccacaatcactacctctcagctgtctgaaggtgcggctgatatatccatcccacgtctaacgtatggagtgtgatagaatatgacgacacaagcatgagaactcgctctctatccaaccaccgaaacactgtcactacagccgttcttgttgctccattcgcttttgtgattccatgccttctctggtgactgacaacattccttccttttctccagccctgttgttatctgctcatgacctacggccactctctatcgcatactaacatagacgatcccagcccgctccccacttccagggcaccgttggcaagcctcctatcctcaagaaggctgaggctgccaacgctgacatggacgagtccttcatcggaatgtctggaggagagatcttccacgagatgatgctgcgacacaacgtcgacactgtcttcggttaccccggtggagccattctccccgtctttgacgccattcacaactctgagtacttcaactttgtgctccctcgacacgagcagggtgccggccacatggccgagggctacgctcgagcctctggtaagcccggtgtcgttctcgtcacctctggccccggtgccaccaacgtcatcacccccatgcaggacgctctttccgatggtacccccatggttgtcttcaccggtcaggtcctgacctccgttatcggcactgacgccttccaggaggccgatgttgtcggcatctcccgatcttgcaccaagtggaacgtcatggtcaagaacgttgctgagctcccccgacgaatcaacgaggcctttgagattgctacttccggccgacccggtcccgttctcgtcgatctgcccaaggatgttactgctgccatcctgcgagagcccatccccaccaagtccaccattccctcgcattctctgaccaacctcacctctgccgccgccaccgagttccagaagcaggctatccagcgagccgccaacctcatcaaccagtccaagaagcccgtcctttacgtcggacagggtatccttggctccgaggagggtcctaagctgcttaaggagctggctgagaaggccgagattcccgtcaccactactctgcagggtcttggtgcctttgacgagcgagaccccaagtctctgcacatgctcggtatgcacggttccggctacgccaacatggccatgcagaacgctgactgtatcattgctctcggcgcccgatttgatgaccgagttaccggctccatccccaagtttgcccccgaggctcgagccgctgcccttgagggtcgaggtggtattgttcactttgagatccaggccaagaacatcaacaaggttgttcaggccaccgaagccgttgagggagacgttaccgagtctgtccgacagctcatccccctcatcaacaaggtctctgccgctgagcgagctccctggactgagactatccagtcctggaagcagcagttccccttcctcttcgaggctgaaggtgaggatggtgttatcaagccccagtccgtcattgctctgctctctgacctgacagagaacaacaaggacaagaccatcatcaccaccggtgttggtcagcatcagatgtggactgcccagcatttccgatggcgacaccctcgaaccatgatcacttctggtggtcttggaactatgggttacggcctgcccgccgctatcggcgccaaggttgcccgacctgactgcgacgtcattgacatcgatggtgacgcttctttcaacatgactctgaccgagctgtccaccgccgttcagttcaacattggcgtcaaggctattgtcctcaacaacgaggaacagggtatggtcacccagctgcagtctctcttctacgagaaccgatactgccacactcatcagaagaaccccgacttcatgaagctggccgagtccatgggcatgaagggtatccgaatcactcacattgaccagctggaggccggtctcaaggagatgctcgcatacaagggccctgtgctcgttgaggttgttgtcgacaagaagatccccgttcttcccatggttcccgctggtaaggctttgcatgagttccttgtctacgacgctgacgccgaggctgcttctcgacccgatcgactgaagaatgcccccgcccctcacgtccaccagaccacctttgagaactaagtggaaaggaacacaagcaatccgaaccaaaaataattggggtcccgtgcccacagagtctagtgcagacctaaaatgaccacagtaaattatagctgttattaaacatgagattttgaccaacaagagcgtaggaatgttattagctactacttgtacatacacagcatttgttttaaataatgttgcctccaggggcagtgagatcaggacccagatccgtggccagctctctgacttcagaccgcttgtacttaagcagctcgcaacactgttgtcgaggattgaacttgccatattcgattttgtggtcatgaatccagcacacctcatttaaatgtagctaacggtagcaggcgaactactggtacatacctcccccggaatatgtacaggcataatgcgtatctgtgggacatgtggtcgttgcgccattatgtaagcagcgtgtactcctctgactgtccatatggtttgctccatctcaccctcatcgttttcattgttcacaggcggccacaaaaaaactgtcttctctccttctctcttcgccttagtctactcggaccagttttagtttagcttggcgccactggataaatgagacctcaggccttgtgatgaggaggtcacttatgaagcatgttaggaggtgcttgtatggatagagaagcacccaaaataataagaataataataaaacagggggcgttgtcatttcatatcgtgttttcaccatcaatacacctccaaacaatgcccttcatgtggccagccccaatattgtcctgtagttcaactctatgcagctcgtatcttattgagcaagtaaaactctgtcagccgatattgcccgacccgcgacaagggtcaacaaggtggtgtaaggccttcgcagaagtcaaaactgtgccaaacaaacatctagagtctctttggtgtttctcgcatatatttwatcggctgtcttacgtatttgcgcctcggtaccggactaatttcggatcatccccaatacgctttttcttcgcagctgtcaacagtgtccatgatctatccacctaaatgggtcatatgaggcgtataatttcgtggtgctgataataattcccatatatttgacacaaaacttccccccctagacatacatctcacaatctcacttcttgtgcttctgtcacacatctcctccagctgacttcaactcacacctctgccccagttggtctacagcggtataaggtttctccgcatagaggtgcaccactcctcccgatacttgtttgtgtgacttgtgggtcacgacatatatatctacacacattgcgccaccctttggttcttccagcacaacaaaaacacgacacgctaaccatggccaatttactgaccgtacaccaaaatttgcctgcattaccggtcgatgcaacgagtgatgaggttcgcaagaacctgatggacatgttcagggatcgccaggcgttttctgagcatacctggaaaatgcttctgtccgtttgccggtcgtgggcggcatggtgcaagttgaataaccggaaatggtttcccgcagaacctgaagatgttcgcgattatcttctatatcttcaggcgcgcggtctggcagtaaaaactatccagcaacatttgggccagctaaacatgcttcatcgtcggtccgggctgccacgaccaagtgacagcaatgctgtttcactggttatgcggcggatccgaaaagaaaacgttgatgccggtgaacgtgcaaaacaggctctagcgttcgaacgcactgatttcgaccaggttcgttcactcatggaaaatagcgatcgctgccaggatatacgtaatctggcatttctggggattgcttataacaccctgttacgtatagccgaaattgccaggatcagggttaaagatatctcacgtactgacggtgggagaatgttaatccatattggcagaacgaaaacgctggttagcaccgcaggtgtagagaaggcacttagcctgggggtaactaaactggtcgagcgatggatttccgtctctggtgtagctgatgatccgaataactacctgttttgccgggtcagaaaaaatggtgttgccgcgccatctgccaccagccagctatcaactcgcgccctggaagggatttttgaagcaactcatcgattgatttacggcgctaaggatgactctggtcagagatacctggcctggtctggacacagtgcccgtgtcggagccgcgcgagatatggcccgcgctggagtttcaataccggagatcatgcaagctggtggctggaccaatgtaaatattgtcatgaactatatccgtaacctggatagtgaaacaggggcaatggtgcgcctgctggaagatggcgattaagc

SEQ ID NO: 344 - DNA, 2987 bp, Yarrowia lipolytica
  misc_feature: mutant acetohydroxyacid synthase (AHAS) with W497L mutation
  ref <302>: TITLE: HIGH EICOSAPENTAENOIC ACID PRODUCING STRAINS OF YARROWIA LIPOLYTICA
  ref <310>: PATENT DOCUMENT NUMBER: US 2006-0115881-A1
  ref <311>: PATENT FILING DATE: 2005-11-02
  ref <312>: PUBLICATION DATE: 2006-06-01
  ref <313>: RELEVANT RESIDUES IN SEQ ID NO: (1)..(2987)
  ref <302>: TITLE: HIGH EICOSAPENTAENOIC ACID PRODUCING STRAINS OF YARROWIA LIPOLYTICA
  ref <310>: PATENT DOCUMENT NUMBER: WO 2006/052870
  ref <311>: PATENT FILING DATE: 2005-11-03
  ref <312>: PUBLICATION DATE: 2006-05-18
  ref <313>: RELEVANT RESIDUES IN SEQ ID NO: (1)..(2987)
ttccctagtcccagtgtacacccgccgatatcgcttaccctgcagccggattaaggttggcaatttttcacgtccttgtctccgcaattactcaccgggtggtttataagattgcaagcgtcttgatttgtctctgtatactaacatgcaatcgcgactcgcccgacgggccactaacctggccagaatctccagatccaagtattctcttggtctgcgatatgtttccaacacaaaagcccctgctgcccagccggcaactgctgagtgagtattccttgccataaacgacccagaaccactgtatagtgtttggaagcactagtcagaagaccagcgaaaacaggtggaaaaaactgagacgaaaagcaacgaccagaaatgtaatgtgtggaaaagcgacacacacagagcagataaagaggtgacaaataacgacaaatgaaatatcagtatcttcccacaatcactacctctcagctgtctgaaggtgcggctgatatatccatcccacgtctaacgtatggagtgtgatagaatatgacgacacaagcatgagaactcgctctctatccaaccaccgaaacactgtcactacagccgttcttgttgctccattcgcttttgtgattccatgccttctctggtgactgacaacattccttccttttctccagccctgttgttatctgctcatgacctacggccactctctatcgcatactaacatagacgatcccagcccgctccccacttccagggcaccgttggcaagcctcctatcctcaagaaggctgaggctgccaacgctgacatggacgagtccttcatcggaatgtctggaggagagatcttccacgagatgatgctgcgacacaacgtcgacactgtcttcggttaccccggtggagccattctccccgtctttgacgccattcacaactctgagtacttcaactttgtgctccctcgacacgagcagggtgccggccacatggccgagggctacgctcgagcctctggtaagcccggtgtcgttctcgtcacctctggccccggtgccaccaacgtcatcacccccatgcaggacgctctttccgatggtacccccatggttgtcttcaccggtcaggtcctgacctccgttatcggcactgacgccttccaggaggccgatgttgtcggcatctcccgatcttgcaccaagtggaacgtcatggtcaagaacgttgctgagctcccccgacgaatcaacgaggcctttgagattgctacttccggccgacccggtcccgttctcgtcgatctgcccaaggatgttactgctgccatcctgcgagagcccatccccaccaagtccaccattccctcgcattctctgaccaacctcacctctgccgccgccaccgagttccagaagcaggctatccagcgagccgccaacctcatcaaccagtccaagaagcccgtcctttacgtcggacagggtatccttggctccgaggagggtcctaagctgcttaaggagctggctgagaaggccgagattcccgtcaccactactctgcagggtcttggtgcctttgacgagcgagaccccaagtctctgcacatgctcggtatgcacggttccggctacgccaacatggccatgcagaacgctgactgtatcattgctctcggcgcccgatttgatgaccgagttaccggctccatccccaagtttgcccccgaggctcgagccgctgcccttgagggtcgaggtggtattgttcactttgagatccaggccaagaacatcaacaaggttgttcaggccaccgaagccgttgagggagacgttaccgagtctgtccgacagctcatccccctcatcaacaaggtctctgccgctgagcgagctccctggactgagactatccagtcctggaagcagcagttccccttcctcttcgaggctgaaggtgaggatggtgttatcaagccccagtccgtcattgctctgctctctgacctgacagagaacaacaaggacaagaccatcatcaccaccggtgttggtcagcatcagatgtggactgcccagcatttccgatggcgacaccctcgaaccatgatcacttctggtggtcttggaactatgggttacggcctgcccgccgctatcggcgccaaggttgcccgacctgactgcgacgtcattgacatcgatggtgacgcttctttcaacatgactctgaccgagctgtccaccgccgttcagttcaacattggcgtcaaggctattgtcctcaacaacgaggaacagggtatggtcacccagctgcagtctctcttctacgagaaccgatactgccacactcatcagaagaaccccgacttcatgaagctggccgagtccatgggcatgaagggtatccgaatcactcacattgaccagctggaggccggtctcaaggagatgctcgcatacaagggccctgtgctcgttgaggttgttgtcgacaagaagatccccgttcttcccatggttcccgctggtaaggctttgcatgagttccttgtctacgacgctgacgccgaggctgcttctcgacccgatcgactgaagaatgcccccgcccctcacgtccaccagaccacctttgagaactaagtggaaaggaacacaagcaatccgaaccaaaaataattggggtcccgtgcccacagagtctagtgcagacctaaaatgaccacagtaaattatagctgttattaaacatgagattttgaccaacaagagcgtaggaatgttattagctactacttgtacatacacagcatttgttttaaataatgttgcctccaggggcagtgagatcaggacccagatccgtggccagctctctgacttcagaccgcttgtacttaagcagctcgcaacactgttgtcgaggattgaacttgccatattcgattttgtggtcatgaatccagcacacctc

SEQ ID NO: 345 - DNA, 15743 bp, Artificial Sequence
  Plasmid pZP2-2988
ggccgcatgtacatacaagattatttatagaaatgaatcgcgatcgaacaaagagtacgagtgtacgagtaggggatgatgataaaagtggaagaagttccgcatctttggatttatcaacgtgtaggacgatacttcctgtaaaaatgcaatgtctttaccataggttctgctgtagatgttattaactaccattaacatgtctacttgtacagttgcagaccagttggagtatagaatggtacacttaccaaaaagtgttgatggttgtaactacgatatataaaactgttgacgggatctgtatattcggtaagatatattttgtggggttttagtggtgtttaaacagtgtacgcagtactatagaggaacaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacaccatggaggtcgtgaacgaaatcgtctccattggccaggaggttcttcccaaggtcgactatgctcagctctggtctgatgcctcgcactgcgaggtgctgtacctctccatcgccttcgtcatcctgaagttcacccttggtcctctcggacccaagggtcagtctcgaatgaagtttgtgttcaccaactacaacctgctcatgtccatctactcgctgggctccttcctctctatggcctacgccatgtacaccattggtgtcatgtccgacaactgcgagaaggctttcgacaacaatgtcttccgaatcaccactcagctgttctacctcagcaagttcctcgagtacattgactccttctatctgcccctcatgggcaagcctctgacctggttgcagttctttcaccatctcggagctcctatggacatgtggctgttctacaactaccgaaacgaagccgtttggatctttgtgctgctcaacggcttcattcactggatcatgtacggctactattggacccgactgatcaagctcaagttccctatgcccaagtccctgattacttctatgcagatcattcagttcaacgttggcttctacatcgtctggaagtaccggaacattccctgctaccgacaagatggaatgagaatgtttggctggtttttcaactacttctacgttggtactgtcctgtgtctgttcctcaacttctacgtgcagacctacatcgtccgaaagcacaagggagccaaaaagattcagtgagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgggcgtcgttgcttgtgtgatttttgaggacccatccctttggtatataagtatactctggggttaaggttgcccgtgtagtctaggttatagttttcatgtgaaataccgagagccgagggagaataaacgggggtatttggacttgtttttttcgcggaaaagcgtcgaatcaaccctgcgggccttgcaccatgtccacgacgtgtttctcgccccaattcgccccttgcacgtcaaaattaggcctccatctagacccctccataacatgtgactgtggggaaaagtataagggaaaccatgcaaccatagacgacgtgaaagacggggaggaaccaatggaggccaaagaaatggggtagcaacagtccaggagacagacaaggagacaaggagagggcgcccgaaagatcggaaaaacaaacatgtccaattggggcagtgacggaaacgacacggacacttcagtacaatggaccgaccatctccaagccagggttattccggtatcaccttggccgtaacctcccgctggtacctgatattgtacacgttcacattcaatatactttcagctacaataagagaggctgtttgtcgggcatgtgtgtccgtcgtatggggtgatgtccgagggcgaaattcgctacaagcttaactctggcgcttgtccagtatgaatagacaagtcaagaccagtggtgccatgattgacagggaggtacaagacttcgatactcgagcattactcggacttgtggcgattgaacagacgggcgatcgcttctcccccgtattgccggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcgctgatgacactttggtctgaaagagatgcattttgaatcccaaacttgcagtgcccaagtgacatacatctccgcgttttggaaaatgttcagaaacagttgattgtgttggaatggggaatggggaatggaaaaatgactcaagtatcaattccaaaaacttctctggctggcagtacctactgtccatactactgcattttctccagtcaggccactctatactcgacgacacagtagtaaaacccagataatttcgacataaacaagaaaacagacccaataatatttatatatagtcagccgtttgtccagttcagactgtaatagccgaaaaaaaatccaaagtttctattctaggaaaatatattccaatatttttaattcttaatctcatttattttattctagcgaaatacatttcagctacttgagacatgtgatacccacaaatcggattcggactcggttgttcagaagagcatatggcattcgtgctcgcttgttcacgtattcttcctgttccatctcttggccgacaatcacacaaaaatggggttttttttttaattctaatgattcattacagcaaaattgagatatagcagaccacgtattccataatcaccaaggaagttcttgggcgtcttaattaactcacctgcaggattgagactatgaatggattcccgtgcccgtattactctactaatttgatcttggaacgcgaaaatacgtttctaggactccaaagaatctcaactcttgtccttactaaatatactacccatagttgatggtttacttgaacagagaggacatgttcacttgacccaaagtttctcgcatctcttggatatttgaacaacggcgtccactgaccgtcagttatccagtcacaaaacccccacattcatacattcccatgtacgtttacaaagttctcaattccatcgtgcaaatcaaaatcacatctattcattcatcatatataaacccatcatgtctactaacactcacaactccatagaaaacatcgactcagaacacacgctccatgcggccgcttactgagccttggcaccgggctgcttctcggccattcgagcgaactgggacaggtatcggagcaggatgacgagaccttcatggggcagagggtttcggtaggggaggttgtgcttctggcacagctgttccacctggtaggaaacggcagtgaggttgtgtcgaggcagggtgggccagagatggtgctcgatctggtagttcaggcctccaaagaaccagtcagtaatgatgcctcgtcgaatgttcatggtctcatggatctgacccacagagaagccatgtccgtcccagacggaatcaccgatcttctccagagggtagtggttcatgaagaccacgatggcaattccgaagccaccgacgagctcggaaacaaagaacaccagcatcgaggtcaggatggagggcataaagaagaggtggaacagggtcttgagagtccagtgcagagcgagtccaatggcctctttcttgtactgagatcggtagaactggttgtctcggtccttgagggatcgaacggtcagcacagactggaaacaccagatgaatcgcaggagaatacagatgaccaggaaatagtactgttggaactgaatgagctttcgggagatgggagaagctcgagtgacatcgtcctcggaccaggcgagcagaggcaggttatcaatgtcgggatcgtgaccctgaacgttggtagcagaatgatgggcgttgtgtctgtccttccaccaggtcacggagaagccctggagtccgttgccaaagaccagacccaggacgttattccagtttcggttcttgaaggtctggtggtggcagatgtcatgagacagccatcccatttgctggtagtgcataccgagcacgagagcaccaatgaagtacaggtggtactggaccagcatgaagaaggcaagcacgccaagacccagggtggtcaagatcttgtacgagtaccagaggggagaggcgtcaaacatgccagtggcgatcagctcttctcggagctttcggaaatcctcctgagcttcgttgacggcagcctggggaggcagctcggaagcctggttgatcttgggcattcgcttgagcttgtcgaaggcttcctgagagtgcataaccatgaaggcgtcagtagcatctcgtccctggtagttctcaatgatttcagctccaccagggtggaagttcacccaagcggagacgtcgtacacctttccgtcgatgacgaggggcagagcctgtcgagaagccttcaccatggttgtgaattagggtggtgagaatggttggttgtagggaagaatcaaaggccggtctcgggatccgtgggtatatatatatatatatatatatacgatccttcgttacctccctgttctcaaaactgtggtttttcgtttttcgttttttgctttttttgatttttttagggccaactaagcttccagatttcgctaatcacctttgtactaattacaagaaaggaagaagctgattagagttgggctttttatgcaactgtgctactccttatctctgatatgaaagtgtagacccaatcacatcatgtcatttagagttggtaatactgggaggatagataaggcacgaaaacgagccatagcagacatgctgggtgtagccaagcagaagaaagtagatgggagccaattgacgagcgagggagctacgccaatccgacatacgacacgctgagatcgtcttggccggggggtacctacagatgtccaagggtaagtgcttgactgtaattgtatgtctgaggacaaatatgtagtcagccgtataaagtcataccaggcaccagtgccatcatcgaaccactaactctctatgatacatgcctccggtattattgtaccatgcgtcgctttgttacatacgtatcttgcctttttctctcagaaactccagactttggctattggtcgagataagcccggaccatagtgagtctttcacactctacatttctcccttgctccaactatttaaattccttcacttcaagttcattcttcatctgcttctgttttactttgacaggcaaatgaagacatggtacgacttgatggaggccaagaacgccatttcaccccgagacaccgaagtgcctgaaatcctggctgcccccattgataacatcggaaactacggtattccggaaagtgtatatagaacctttccccagcttgtgtctgtggatatggatggtgtaatcccctttgagtactcgtcttggcttctctccgagcagtatgaggctctctaatctagcgcatttaatatctcaatgtatttatatatttatcttctcatgcggccgcttactgagccttggcaccgggctgcttctcggccattcgagcgaactgggacaggtatcggagcaggatgacgagaccttcatggggcagagggtttcggtaggggaggttgtgcttctggcacagctgttccacctggtaggaaacggcagtgaggttgtgtcgaggcagggtgggccagagatggtgctcgatctggtagttcaggcctccaaagaaccagtcagtaatgatgcctcgtcgaatgttcatggtctcatggatctgacccacagagaagccatgtccgtcccagacggaatcaccgatcttctccagagggtagtggttcatgaagaccacgatggcaattccgaagccaccgacgagctcggaaacaaagaacaccagcatcgaggtcaggatggagggcataaagaagaggtggaacagggtcttgagagtccagtgcagagcgagtccaatggcctctttcttgtactgagatcggtagaactggttgtctcggtccttgagggatcgaacggtcagcacagactggaaacaccagatgaatcgcaggagaatacagatgaccaggaaatagtactgttggaactgaatgagctttcgggagatgggagaagctcgagtgacatcgtcctcggaccaggcgagcagaggcaggttatcaatgtcgggatcgtgaccctgaacgttggtagcagaatgatgggcgttgtgtctgtccttccaccaggtcacggagaagccctggagtccgttgccaaagaccagacccaggacgttattccagtttcggttcttgaaggtctggtggtggcagatgtcatgagacagccatcccatttgctggtagtgcataccgagcacgagagcaccaatgaagtacaggtggtactggaccagcatgaagaaggcaagcacgccaagacccagggtggtcaagatcttgtacgagtaccagaggggagaggcgtcaaacatgccagtggcgatcagctcttctcggagctttcggaaatcctcctgagcttcgttgacggcagcctggggaggcagctcggaagcctggttgatcttgggcattcgcttgagcttgtcgaaggcttcctgagagtgcataaccatgaaggcgtcagtagcatctcgtccctggtagttctcaatgatttcagctccaccagggtggaagttcacccaagcggagacgtcgtacacctttccgtcgatgacgaggggcagagcctgtcgagaagccttcaccatgggcaggacctgtgttagtacattgtcggggagtcatcaattggttcgacaggttgtcgactgttagtatgagctcaattgggctctggtgggtcgatgacacttgtcatctgtttctgttgggtcatgtttccatcaccttctatggtactcacaattcgtccgattcgcccgaatccgttaataccgactttgatggccatgttgatgtgtgtttaattcaagaatgaatatagagaagagaagaagaaaaaagattcaattgagccggcgatgcagacccttatataaatgttgccttggacagacggagcaagcccgcccaaacctacgttcggtataatatgttaagctttttaacacaaaggtttggcttggggtaacctgatgtggtgcaaaagaccgggcgttggcgagccattgcgcgggcgaatggggccgtgactcgtctcaaattcgagggcgtgcctcaattcgtgcccccgtggctttttcccgccgtttccgccccgtttgcaccactgcagccgcttctttggttcggacaccttgctgcgagctaggtgccttgtgctacttaaaaagtggcctcccaacaccaacatgacatgagtgcgtgggccaagacacgttggcggggtcgcagtcggctcaatggcccggaaaaaacgctgctggagctggttcggacgcagtccgccgcggcgtatggatatccgcaaggttccatagcgccattgccctccgtcggcgtctatcccgcaacctctaaatagagcgggaatataacccaagcttcttttttttcctttaacacgcacacccccaactatcatgttgctgctgctgtttgactctactctgtggaggggtgctcccacccaacccaacctacaggtggatccggcgctgtgattggctgataagtctcctatccggactaattctgaccaatgggacatgcgcgcaggacccaaatgccgcaattacgtaaccccaacgaaatgcctacccctctttggagcccagcggccccaaatccccccaagcagcccggttctaccggcttccatctccaagcacaagcagcccggaattcctttacctgcaggataacttcgtataatgtatgctatacgaagttatgatctctctcttgagcttttccataacaagttcttctgcctccaggaagtccatgggtggtttgatcatggttttggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgcgataacttcgtataatgtatgctatacgaagttatcgtacgatagttagtagacaacaatcgataacgtctcgtaccaaccacagattacgacccattcgcagtcacagttcactagggtttgggttgcatccgttgagagcggtttgtttttaaccttctccatgtgctcactcaggttttgggttcagatcaaatcaaggcgtgaaccactttgtttgaggacaaatgtgacacaaccaaccagtgtcaggggcaagtccgtgacaaaggggaagatacaatgcaattactgacagttacagactgcctcgatgccctaaccttgccccaaaataagacaactgtcctcgtttaagcgcaaccctattcagcgtcacgtcataatagcgtttggatagcactagtctatgaggagcgttttatgttgcggtgagggcgattggtgctcatatgggttcaattgaggtggcggaacgagcttagtcttcaattgaggtgcgagcgacacaattgggtgtcacgtggcctaattgacctcgggtcgtggagtccccagttatacagcaaccacgaggtgcatgggtaggagacgtcaccagacaatagggttttttttggactggagagggttgggcaaaagcgctcaacgggctgtttggggagctgtgggggaggaattggcgatatttgtgaggttaacggctccgatttgcgtgttttgtcgctcctgcatctccccatacccatatcttccctccccacctctttccacgataattttacggatcagcaataaggttccttctcctagtttccacgtccatatatatctatgctgcgtcgtccttttcgtgacatcaccaaaacacatacaacaatggctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctccatggcctccacctcggctctgcccaagcagaaccctgccctccgacgaaccgtcacttccaccactgtgaccgactcggagtctgctgccgtctctccctccgattctcccagacactcggcctcctctacatcgctgtcttccatgtccgaggtggacattgccaagcccaagtccgagtacggtgtcatgctggatacctacggcaaccagttcgaagttcccgacttcaccatcaaggacatctacaacgctattcccaagcactgcttcaagcgatctgctctcaagggatacggctacattcttcgagacattgtcctcctgactaccactttcagcatctggtacaactttgtgacacccgagtacattccctccactcctgctcgagccggtctgtgggctgtgtacaccgttcttcagggactcttcggtactggactgtgggtcattgcccacgagtgtggacatggtgctttctccgattcccgaatcatcaacgacattactggctgggtgcttcactcttccctgcttgttccctacttcagctggcaaatctcccaccggaagcatcacaaggccactggaaacatggagcgagacatggtcttcgttcctcgaacccgagagcagcaagctactcgactcggcaagatgacccacgaactcgcccatcttaccgaggaaactcctgctttcaccctgctcatgcttgtgcttcagcaactggtcggttggcccaactatctcattaccaacgttactggacacaactaccatgagcggcagcgagagggtcgaggcaagggaaagcacaacggtcttggcggtggagttaaccatttcgatccccgatctcctctgtacgagaacagcgacgccaagctcatcgtgctctccgacattggcattggtcttatggccaccgctctgtactttctcgttcagaagttcggattctacaacatggccatctggtacttcgttccctacttgtgggttaaccactggctcgtcgccattacctttctgcagcacacagatcctactcttccccactacaccaacgacgagtggaactttgtgcgaggtgccgctgcaaccatcgaccgagagatgggcttcattggacgtcatctgctccacggcattatcgagactcacgtcctgcatcactacgtctcttccattcccttctacaatgcggacgaagctaccgaggccatcaaacctatcatgggcaagcactatcgagctgatgtccaggacggtcctcgaggattcattcgagccatgtaccgatctgcacgaatgtgccagtgggttgaaccctccgctggtgccgagggagctggcaagggtgtcctgttctttcgaaaccgaaacaatgtgggcactcctcccgctgtcatcaagcccgttgcctaagc

SEQ ID NO: 346 - DNA, 1434 bp, Fusarium moniliforme
  CDS (1)..(1434): synthetic delta-12 desaturase (codon-optimized for Yarrowia lipolytica)
  ref <302>: TITLE: DELTA-12 DESATURASES SUITABLE FOR ALTERING LEVELS OF POLYUNSATURATED FATTY ACIDS IN OLEAGINOUS YEAST
  ref <310>: PATENT DOCUMENT NUMBER: WO 2005/047485
  ref <311>: PATENT FILING DATE: 2004-11-12
  ref <312>: PUBLICATION DATE: 2005-05-26
  ref <313>: RELEVANT RESIDUES IN SEQ ID NO: (1)..(1434)
  ref <302>: TITLE: DELTA-12 DESATURASES SUITABLE FOR ALTERING LEVELS OF POLYUNSATURATED FATTY ACIDS IN OLEAGINOUS YEAST
  ref <310>: PATENT DOCUMENT NUMBER: US 2005-0216975-A1
  ref <311>: PATENT FILING DATE: 2004-11-10
  ref <312>: PUBLICATION DATE: 2005-09-29
  ref <313>: RELEVANT RESIDUES IN SEQ ID NO: (1)..(1434)
atggcctccacctcggctctgcccaagcagaaccctgccctccgacgaaccgtcacttccaccactgtgaccgactcggagtctgctgccgtctctccctccgattctcccagacactcggcctcctctacatcgctgtcttccatgtccgaggtggacattgccaagcccaagtccgagtacggtgtcatgctggatacctacggcaaccagttcgaagttcccgacttcaccatcaaggacatctacaacgctattcccaagcactgcttcaagcgatctgctctcaagggatacggctacattcttcgagacattgtcctcctgactaccactttcagcatctggtacaactttgtgacacccgagtacattccctccactcctgctcgagccggtctgtgggctgtgtacaccgttcttcagggactcttcggtactggactgtgggtcattgcccacgagtgtggacatggtgctttctccgattcccgaatcatcaacgacattactggctgggtgcttcactcttccctgcttgttccctacttcagctggcaaatctcccaccggaagcatcacaaggccactggaaacatggagcgagacatggtcttcgttcctcgaacccgagagcagcaagctactcgactcggcaagatgacccacgaactcgcccatcttaccgaggaaactcctgctttcaccctgctcatgcttgtgcttcagcaactggtcggttggcccaactatctcattaccaacgttactggacacaactaccatgagcggcagcgagagggtcgaggcaagggaaagcacaacggtcttggcggtggagttaaccatttcgatccccgatctcctctgtacgagaacagcgacgccaagctcatcgtgctctccgacattggcattggtcttatggccaccgctctgtactttctcgttcagaagttcggattctacaacatggccatctggtacttcgttccctacttgtgggttaaccactggctcgtcgccattacctttctgcagcacacagatcctactcttccccactacaccaacgacgagtggaactttgtgcgaggtgccgctgcaaccatcgaccgagagatgggcttcattggacgtcatctgctccacggcattatcgagactcacgtcctgcatcactacgtctcttccattcccttctacaatgcggacgaagctaccgaggccatcaaacctatcatgggcaagcactatcgagctgatgtccaggacggtcctcgaggattcattcgagccatgtaccgatctgcacgaatgtgccagtgggttgaaccctccgctggtgccgagggagctggcaagggtgtcctgttctttcgaaaccgaaacaatgtgggcactcctcccgctgtcatcaagcccgttgcctaa

SEQ ID NO: 347 - protein, 477 aa, Fusarium moniliforme; identical to SEQ ID NO: 317

SEQ ID NO: 348 - DNA, 15812 bp, Artificial Sequence
  Plasmid pZKL2-5U89GC
gtacgttatcatttgaacagtgaaaggctacagtaacagaagcagttgtaaacttcattccgttgattctgtactacagtaccccactacgccgcttccgctgacactgttcaacccaaaaactacatctgcgtgcgctgtgtaaggctatcatcagatacatactgtagattctgtagatgcgaacctgcttgtatcatatacatccccctccccctgacctgcacaagcaagcaatgtgacattgatattgctgcttatctagtgccgaggatgtgaaagccgagactcaaacatttcttttactctcttgttcctgaccagacctggcggagattacgccagtatgattcttgcaggtctgagacaagcctggaacagccaacatttatttttcgaagcgagaaacatgccacaccccggcacgttcagagatgcatatgatttgtttttcgagtaacagtacccccccccccccccccaatgaaaccagtattactcacaccatcctcattcaaagcgttacactgattacgcgcccatcaacgacagcatgaggggactgctgatctgatctaatcaaatgactacaaaaatcgcaataatgaagagcaaacgacaaaaaagaaacaggttaaccaatcccgcttcaatgtctcaccacaatccagcactgtttctcattacctcctccctctaatttcagagttgcatcagggtccttgatggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgctggtttcgatttgtcttagaggaacgcatatacagtaatcatagagaataaacgatattcatttattaaagtagatagttgaggtagaagttgtaaagagtgataaatagcttagataccacagacaccctcggtgacgaagtactgcagatggtttccaatcacattgacctgctggagcagagtgttaccggcagagcactgtttattgctctggccctggcacatgacaacgttggagagaggagggtggatcaggggccagtcaataaagacctcaccagagcagtgctggtaaccgtcccagaagggcacttgagggacgatatctcctcggtgggtgattcggtagagctttcggtctttggacaccttggagacatcggggttctcctggccaaagaagagtttatcgacccagttagcaaagccagcgttaccgacaatgggctgaccaagagtaacaacgaggggatcgtggccgttaaccttgaggttgattccgaacagaagggctgcagctcctccgagagagtgaccggtgacagcaatctggtagtcgggatactgctcaatcacagagtcgagcttggggccgatctgattgtaggtgttgttgtaggactggatgaagccattgtggacaagacagtcatcacaagtagcagtagaagagatgttagcagcaagatcaaagttaattaactcacctgcaggattgagactatgaatggattcccgtgcccgtattactctactaatttgatcttggaacgcgaaaatacgtttctaggactccaaagaatctcaactcttgtccttactaaatatactacccatagttgatggtttacttgaacagagaggacatgttcacttgacccaaagtttctcgcatctcttggatatttgaacaacggcgtccactgaccgtcagttatccagtcacaaaacccccacattcatacattcccatgtacgtttacaaagttctcaattccatcgtgcaaatcaaaatcacatctattcattcatcatatataaacccatcatgtctactaacactcacaactccatagaaaacatcgactcagaacacacgctccatgcggccgcttaggaatcctgagcgtccttgacacagtgaaccacaccgactttgtgcatgtacttgagggtggaaatgatgttgcccacaatggtagggtagaagacgtaccgaactccgtgtcgttcgcaacactctcggacagcttgctgcacgaagggatagtgccaagacgacattcgaggaaagaggtgatgctcgatctggaagttgagaccgccagtaaagaacatggcaatgggtccaccgtaggtggaagaggtctccacctgagctctgtaccagtcgatctgatcggcttcaacgtccttctcggagctcttgaccttgcagttcttgtcggggattcgctccgagccatcgaagttgtgagacaagatgaaaaagaaggtgaggaaggcaccggtagcagtgggcaccagaggaatggtgatgagcagggaggttccagtgagataccagggcaagaaggcggttcgaaagatgaagaaagctcgcataacgaatgcaagggttcggtaccgtcgcagaaagccgttctctcgcatggctgtgacagactcgggaatggtgtcgttgtgctgcattcggaagatgtagagagggttgtacaccagcgaaacgccgtaggctccaagcacgaggtacatgtaccaggcctggaatcggtgaaaccactttcgagcagtgttggcagcagggtagttgtggaacacaaggaatggttctgcggactcggcatccaggtcgagaccatgctgattggtgtaggtgtgatgtcgcatgatgtgagactgcagccagatccatctggacgatccaatgacgtcgatgccgtaggcaaagagagcgttgacccagggctttttgctgatggcaccatgagaggcatcgtgctgaatggacaggccgatctgcatgtgcatgaatccagtcaagagaccccacagcaccattccggtagtagcccagtgccactcgcaaaaggcggtgacagcaatgatgccaacggttcgcagccagaatccaggtgtggcataccagttccgacctttcatgacctctcgcatagttcgcttgacgtcctgtgcaaagggagagtcgtaggtgtagacaatgtccttggaggttcggtcgtgcttgcctcgcacgaactgttgaagcagcttcgagttctcgggcttgacgtaagggtgcatggagtagaacagaggagaagcatcggaggcaccagaagcgaggatcaagtcgcctccgggatggaccttggcaagaccttccagatcgtagagaatgccgtcgatggcaaccaggtcgggtcgctcgagcagctgctcggtagtaagggagagagccatggttgtgaattagggtggtgagaatggttggttgtagggaagaatcaaaggccggtctcgggatccgtgggtatatatatatatatatatatatacgatccttcgttacctccctgttctcaaaactgtggtttttcgtttttcgttttttgctttttttgatttttttagggccaactaagcttccagatttcgctaatcacctttgtactaattacaagaaaggaagaagctgattagagttgggctttttatgcaactgtgctactccttatctctgatatgaaagtgtagacccaatcacatcatgtcatttagagttggtaatactgggaggatagataaggcacgaaaacgagccatagcagacatgctgggtgtagccaagcagaagaaagtagatgggagccaattgacgagcgagggagctacgccaatccgacatacgacacgctgagatcgtcttggccggggggtacctacagatgtccaagggtaagtgcttgactgtaattgtatgtctgaggacaaatatgtagtcagccgtataaagtcataccaggcaccagtgccatcatcgaaccactaactctctatgatacatgcctccggtattattgtaccatgcgtcgctttgttacatacgtatcttgcctttttctctcagaaactccagaattctctctcttgagcttttccataacaagttcttctgcctccaggaagtccatgggtggtttgatcatggttttggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgaccttttccttgggaaccaccaccgtcagcccttctgactcacgtattgtagccaccgacacaggcaacagtccgtggatagcagaatatgtcttgtcggtccatttctcaccaactttaggcgtcaagtgaatgttgcagaagaagtatgtgccttcattgagaatcggtgttgctgatttcaataaagtcttgagatcagtttggccagtcatgttgtggggggtaattggattgagttatcgcctacagtctgtacaggtatactcgctgcccactttatactttttgattccgctgcacttgaagcaatgtcgtttaccaaaagtgagaatgctccacagaacacaccccagggtatggttgagcaaaaaataaacactccgatacggggaatcgaaccccggtctccacggttctcaagaagtattcttgatgagagcgtatcgatcgaggaagaggacaagcggctgcttcttaagtttgtgacatcagtatccaaggcaccattgcaaggattcaaggctttgaacccgtcatttgccattcgtaacgctggtagacaggttgatcggttccctacggcctccacctgtgtcaatcttctcaagctgcctgactatcaggacattgatcaacttcggaagaaacttttgtatgccattcgatcacatgctggtttcgatttgtcttagaggaacgcatatacagtaatcatagagaataaacgatattcatttattaaagtagatagttgaggtagaagttgtaaagagtgataaatagcggccgctcactgaatctttttggctcccttgtgctttcggacgatgtaggtctgcacgtagaagttgaggaacagacacaggacagtaccaacgtagaagtagttgaaaaaccagccaaacattctcattccatcttgtcggtagcagggaatgttccggtacttccagacgatgtagaagccaacgttgaactgaatgatctgcatagaagtaatcagggacttgggcatagggaacttgagcttgatcagtcgggtccaatagtagccgtacatgatccagtgaatgaagccgttgagcagcacaaagatccaaacggcttcgtttcggtagttgtagaacagccacatgtccataggagctccgagatggtgaaagaactgcaaccaggtcagaggcttgcccatgaggggcagatagaaggagtcaatgtactcgaggaacttgctgaggtagaacagctgagtggtgattcggaagacattgttgtcgaaagccttctcgcagttgtcggacatgacaccaatggtgtacatggcgtaggccatagagaggaaggagcccagcgagtagatggacatgagcaggttgtagttggtgaacacaaacttcattcgagactgacccttgggtccgagaggaccaagggtgaacttcaggatgacgaaggcgatggagaggtacagcacctcgcagtgcgaggcatcagaccagagctgagcatagtcgaccttgggaagaacctcctggccaatggagacgatttcgttcacgacctccatggttgatgtgtgtttaattcaagaatgaatatagagaagagaagaagaaaaaagattcaattgagccggcgatgcagacccttatataaatgttgccttggacagacggagcaagcccgcccaaacctacgttcggtataatatgttaagctttttaacacaaaggtttggcttggggtaacctgatgtggtgcaaaagaccgggcgttggcgagccattgcgcgggcgaatggggccgtgactcgtctcaaattcgagggcgtgcctcaattcgtgcccccgtggctttttcccgccgtttccgccccgtttgcaccactgcagccgcttctttggttcggacaccttgctgcgagctaggtgccttgtgctacttaaaaagtggcctcccaacaccaacatgacatgagtgcgtgggccaagacacgttggcggggtcgcagtcggctcaatggcccggaaaaaacgctgctggagctggttcggacgcagtccgccgcggcgtatggatatccgcaaggttccatagcgccattgccctccgtcggcgtctatcccgcaacctctaaatagagcgggaatataacccaagcttcttttttttcctttaacacgcacacccccaactatcatgttgctgctgctgtttgactctactctgtggaggggtgctcccacccaacccaacctacaggtggatccggcgctgtgattggctgataagtctcctatccggactaattctgaccaatgggacatgcgcgcaggacccaaatgccgcaattacgtaaccccaacgaaatgcctacccctctttggagcccagcggccccaaatccccccaagcagcccggttctaccggcttccatctccaagcacaagcagcccggttctaccggcttccatctccaagcacccctttctccacaccccacaaaaagacccgtgcaggacatcctactgcgtgtttaaacaccactaaaaccccacaaaatatatcttaccgaatatacagatctactatagaggaacaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctccatggtgaaggcttctcgacaggctctgcccctcgtcatcgacggaaaggtgtacgacgtctccgcttgggtgaacttccaccctggtggagctgaaatcattgagaactaccagggacgagatgctactgacgccttcatggttatgcactctcaggaagccttcgacaagctcaagcgaatgcccaagatcaaccaggcttccgagctgcctccccaggctgccgtcaacgaagctcaggaggatttccgaaagctccgagaagagctgatcgccactggcatgtttgacgcctctcccctctggtactcgtacaagatcttgaccaccctgggtcttggcgtgcttgccttcttcatgctggtccagtaccacctgtacttcattggtgctctcgtgctcggtatgcactaccagcaaatgggatggctgtctcatgacatctgccaccaccagaccttcaagaaccgaaactggaataacgtcctgggtctggtctttggcaacggactccagggcttctccgtgacctggtggaaggacagacacaacgcccatcattctgctaccaacgttcagggtcacgatcccgacattgataacctgcctctgctcgcctggtccgaggacgatgtcactcgagcttctcccatctcccgaaagctcattcagttccaacagtactatttcctggtcatctgtattctcctgcgattcatctggtgtttccagtctgtgctgaccgttcgatccctcaaggaccgagacaaccagttctaccgatctcagtacaagaaagaggccattggactcgctctgcactggactctcaagaccctgttccacctcttctttatgccctccatcctgacctcgatgctggtgttctttgtttccgagctcgtcggtggcttcggaattgccatcgtggtcttcatgaaccactaccctctggagaagatcggtgattccgtctgggacggacatggcttctctgtgggtcagatccatgagaccatgaacattcgacgaggcatcattactgactggttctttggaggcctgaactaccagatcgagcaccatctctggcccaccctgcctcgacacaacctcactgccgtttcctaccaggtggaacagctgtgccagaagcacaacctcccctaccgaaaccctctgccccatgaaggtctcgtcatcctgctccgatacctgtcccagttcgctcgaatggccgagaagcagcccggtgccaaggctcagtaagcggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaatttaaatagttggagcaagggagaaatgtagagtgtgaaagactcactatggtccgggcttatctcgaccaatagccaaagtctggagtttctgagagaaaaaggcaagatacgtatgtaacaaagcgacgcatggtacaataataccggaggcatgtatcatagagagttagtggttcgatgatggcactggtgcctggtatgactttatacggctgactacatatttgtcctcagacatacaattacagtcaagcacttacccttggacatctgtaggtaccccccggccaagacgatctcagcgtgtcgtatgtcggattggcgtagctccctcgctcgtcaattggctcccatctactttcttctgcttggctacacccagcatgtctgctatggctcgttttcgtgccttatctatcctcccagtattaccaactctaaatgacatgatgtgattgggtctacactttcatatcagagataaggagtagcacagttgcataaaaagcccaactctaatcagcttcttcctttcttgtaattagtacaaaggtgattagcgaaatctggaagcttagttggccctaaaaaaatcaaaaaaagcaaaaaacgaaaaacgaaaaaccacagttttgagaacagggaggtaacgaaggatcgtatatatatatatatatatatatacccacggatcccgagaccggcctttgattcttccctacaaccaaccattctcaccaccctaattcacaaccatgggcgtattcattaaacaggagcagcttccggctctcaagaagtacaagtactccgccgaggatcactcgttcatctccaacaacattctgcgccccttctggcgacagtttgtcaaaatcttccctctgtggatggcccccaacatggtgactctgctgggcttcttctttgtcattgtgaacttcatcaccatgctcattgttgatcccacccacgaccgcgagcctcccagatgggtctacctcacctacgctctgggtctgttcctttaccagacatttgatgcctgtgacggatcccatgcccgacgaactggccagagtggaccccttggagagctgtttgaccactgtgtcgacgccatgaatacctctctgattctcacggtggtggtgtccaccacccatatgggatataacatgaagctactgattgtgcagattgccgctctcggaaacttctacctgtcgacctgggagacctaccataccggaactctgtacctttctggcttctctggtcctgttgaaggtatcttgattctggtggctcttttcgtcctcaccttcttcactggtcccaacgtgtacgctctgaccgtctacgaggctcttcccgagtccatcacttcgctgctgcctgccagcttcctggacgtcaccatcacccagatctacattggattcggagtgctgggcatggtgttcaacatctacggcgcctgcggaaacgtgatcaagtactacaacaacaagggcaagagcgctctccccgccattctcggaatcgccccctttggcatcttctacgtcggcgtctttgcctgggcccatgttgctcctctgcttctctccaagtacgccatcgtctatctgtttgccattggggctgcctttgccatgcaagtcggccagatgattcttgcccatctcgtgcttgctccctttccccactggaacgtgctgctcttcttcccctttgtgggactggcagtgcactacattgcacccgtgtttggctgggacgccgatatcgtgtcggttaacactctcttcacctgttttggcgccaccctctccatttacgccttctttgtgcttgagatcatcgacgagatcaccaactacctcgatatctggtgtctgcgaatcaagtaccctcaggagaagaagaccgaataagcggccgcatggagcgtgtgttctgagtcgatgttttctatggagttgtgagtgttagtagacatgatgggtttatatatgatgaatgaatagatgtgattttgatttgcacgatggaattgagaactttgtaaacgtacatgggaatgtatgaatgtgggggttttgtgactggataactgacggtcagtggacgccgttgttcaaatatccaagagatgcgagaaactttgggtcaagtgaacatgtcctctctgttcaagtaaaccatcaactatgggtagtatatttagtaaggacaagagttgagattctttggagtcctagaaacgtattttcgcgttccaagatcaaattagtagagtaatacgggcacgggaatccattcatagtctcaatcctgcaggtgagttaattaatcgagcttggcgtaatcatggtcatagctgtttcctgtgtgaaattgttatccgctcacaattccacacaac

SEQ ID NO: 349 - DNA, 1185 bp, Yarrowia lipolytica
  CDS (1)..(1185): diacylglycerol cholinephosphotransferase (YlCPT1)
  ref <302>: TITLE: HIGH EICOSAPENTAENOIC ACID PRODUCING STRAINS OF
  ref <310>: PATENT DOCUMENT NUMBER: WO 2006/052870
  ref <311>: PATENT FILING DATE: 2005-11-03
  ref <312>: PUBLICATION DATE: 2006-05-18
  ref <313>: RELEVANT RESIDUES IN SEQ ID NO: (1)..(1185)
  ref <302>: TITLE: HIGH EICOSAPENTAENOIC ACID PRODUCING STRAINS OF
  ref <310>: PATENT DOCUMENT NUMBER: US 2006-0115881-A1
  ref <311>: PATENT FILING DATE: 2005-11-02
  ref <312>: PUBLICATION DATE: 2006-06-01
  ref <313>: RELEVANT RESIDUES IN SEQ ID NO: (1)..(1185)
atgggcgtattcattaaacaggagcagcttccggctctcaagaagtacaagtactccgccgaggatcactcgttcatctccaacaacattctgcgccccttctggcgacagtttgtcaaaatcttccctctgtggatggcccccaacatggtgactctgttgggcttcttctttgtcattgtgaacttcatcaccatgctcattgttgatcccacccacgaccgcgagcctcccagatgggtctacctcacctacgctctgggtctgttcctttaccagacatttgatgcctgtgacggatcccatgcccgacgaactggccagagtggaccccttggagagctgtttgaccactgtgtcgacgccatgaatacctctctgattctcacggtggtggtgtccaccacccatatgggatataacatgaagctgctgattgtgcagattgccgctctcggaaacttctacctgtcgacctgggagacctaccataccggaactctgtacctttctggcttctctggtcctgttgaaggtatcttgattctggtggctcttttcgtcctcaccttcttcactggtcccaacgtgtacgctctgaccgtctacgaggctcttcccgaatccatcacttcgctgctgcctgccagcttcctggacgtcaccatcacccagatctacattggattcggagtgctgggcatggtgttcaacatctacggcgcctgcggaaacgtgatcaagtactacaacaacaagggcaagagcgctctccccgccattctcggaatcgccccctttggcatcttctacgtcggcgtctttgcctgggcccatgttgctcctctgcttctctccaagtacgccatcgtctatctgtttgccattggggctgcctttgccatgcaagtcggccagatgattcttgcccatctcgtgcttgctcccttcccccactggaacgtgctgctcttcttcccctttgtgggactggcagtgcactacattgcacccgtgtttggctgggacgccgatatcgtgtcggttaacactctcttcacctgttttggcgccaccctctccatttacgccttctttgtgcttgagatcatcgacgagatcaccaactacctcgatatctggtgtctgcgaatcaagtaccctcaggagaagaagactgagtaa

SEQ ID NO: 350 - protein, 394 aa, Yarrowia lipolytica
MGVFIKQEQLPALKKYKYSAEDHSFISNNILRPFWRQFVKIFPLWMAPNMVTLLGFFFVIVNFITMLIVDPTHDREPPRWVYLTYALGLFLYQTFDACDGSHARRTGQSGPLGELFDHCVDAMNTSLILTVVVSTTHMGYNMKLLIVQIAALGNFYLSTWETYHTGTLYLSGFSGPVEGILILVALFVLTFFTGPNVYALTVYEALPESITSLLPASFLDVTITQIYIGFGVLGMVFNIYGACGNVIKYYNNKGKSALPAILGIAPFGIFYVGVFAWAHVAPLLLSKYAIVYLFAIGAAFAMQVGQMILAHLVLAPFPHWNVLLFFPFVGLAVHYIAPVFGWDADIVSVNTLFTCFGATLSIYAFFVLEIIDEITNYLDIWCLRIKYPQEKKTE

SEQ ID NO: 351 - DNA, 6303 bp, Artificial Sequence
  Plasmid pZKUE3S
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgacttaattaatcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgacgagtatctgtctgactcgtcattgcatgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtttaaacccggaaccggaatcgataagcttgatatcgaattcatgctgttcatcgtggttaatgctgctgtgtgctgtgtgtgtgtgttgtttggcgctcattgttgcgttatgcagcgtacaccacaatattggaagcttattagcctttctattttttcgtttgcaaggcttaacaacattgctgtggagagggatggggatatggaggccgctggagggagtcggagaggcgttttggagcggcttggcctggcgcccagctcgcgaaacgcacctaggaccctttggcacgccgaaatgtgccacttttcagtctagtaacgccttacctacgtcattccatgcgtgcatgtttgcgccttttttcccttgcccttgatcgccacacagtacagtgcactgtacagtggaggttttgggggggtcttagatgggagctaaaagcggcctagcggtacactagtgggattgtatggagtggcatggagcctaggtggagcctgacaggacgcacgaccggctagcccgtgacagacgatgggtggctcctgttgtccaccgcgtacaaatgtttgggccaaagtcttgtcagccttgcttgcgaacctaattcccaattttgtcacttcgcacccccattgatcgagccctaacccctgcccatcaggcaatccaattaagctcgcattgtctgccttgtttagtttggctcctgcccgtttcggcgtccacttgcacaaacacaaacaagcattatatataaggctcgtctctccctcccaaccacactcacttttttgcccgtcttcccttgctaacacaaaagtcaagaacacaaacaaccaccccaacccccttacacacaagacatatctacaccatggagtctggacccatgcctgctggcattcccttccctgagtactatgacttctttatggactggaagactcccctggccatcgctgccacctacactgctgccgtcggtctcttcaaccccaaggttggcaaggtctcccgagtggttgccaagtcggctaacgcaaagcctgccgagcgaacccagtccggagctgccatgactgccttcgtctttgtgcacaacctcattctgtgtgtctactctggcatcaccttctactacatgtttcctgctatggtcaagaacttccgaacccacacactgcacgaagcctactgcgacacggatcagtccctctggaacaacgcacttggctactggggttacctcttctacctgtccaagttctacgaggtcattgacaccatcatcatcatcctgaagggacgacggtcctcgctgcttcagacctaccaccatgctggagccatgattaccatgtggtctggcatcaactaccaagccactcccatttggatctttgtggtcttcaactccttcattcacaccatcatgtactgttactatgccttcacctctatcggattccatcctcctggcaaaaagtacctgacttcgatgcagattactcagtttctggtcggtatcaccattgccgtgtcctacctcttcgttcctggctgcatccgaacacccggtgctcagatggctgtctggatcaacgtcggctacctgtttcccttgacctatctgttcgtggactttgccaagcgaacctactccaagcgatctgccattgccgctcagaaaaaggctcagtaagc

SEQ ID NO: 352 - DNA, 15877 bp, Artificial Sequence
  Plasmid pZKL1-2SP98C
aaatgatgtcgacgcagtaggatgtcctgcacgggtctttttgtggggtgtggagaaaggggtgcttggatcgatggaagccggtagaaccgggctgcttgtgcttggagatggaagccggtagaaccgggctgcttggggggatttggggccgctgggctccaaagaggggtaggcatttcgttggggttacgtaattgcggcatttgggtcctgcgcgcatgtcccattggtcagaattagtccggataggagacttatcagccaatcacagcgccggatccacctgtaggttgggttgggtgggagcacccctccacagagtagagtcaaacagcagcagcaacatgatagttgggggtgtgcgtgttaaaggaaaaaaaagaagcttgggttatattcccgctctatttagaggttgcgggatagacgccgacggagggcaatggcgctatggaaccttgcggatatccatacgccgcggcggactgcgtccgaaccagctccagcagcgttttttccgggccattgagccgactgcgaccccgccaacgtgtcttggcccacgcactcatgtcatgttggtgttgggaggccactttttaagtagcacaaggcacctagctcgcagcaaggtgtccgaaccaaagaagcggctgcagtggtgcaaacggggcggaaacggcgggaaaaagccacgggggcacgaattgaggcacgccctcgaatttgagacgagtcacggccccattcgcccgcgcaatggctcgccaacgcccggtcttttgcaccacatcaggttaccccaagccaaacctttgtgttaaaaagcttaacatattataccgaacgtaggtttgggcgggcttgctccgtctgtccaaggcaacatttatataagggtctgcatcgccggctcaattgaatcttttttcttcttctcttctctatattcattcttgaattaaacacacatcaaccatgggcgtattcattaaacaggagcagcttccggctctcaagaagtacaagtactccgccgaggatcactcgttcatctccaacaacattctgcgccccttctggcgacagtttgtcaaaatcttccctctgtggatggcccccaacatggtgactctgctgggcttcttctttgtcattgtgaacttcatcaccatgctcattgttgatcccacccacgaccgcgagcctcccagatgggtctacctcacctacgctctgggtctgttcctttaccagacatttgatgcctgtgacggatcccatgcccgacgaactggccagagtggaccccttggagagctgtttgaccactgtgtcgacgccatgaatacctctctgattctcacggtggtggtgtccaccacccatatgggatataacatgaagctactgattgtgcagattgccgctctcggaaacttctacctgtcgacctgggagacctaccataccggaactctgtacctttctggcttctctggtcctgttgaaggtatcttgattctggtggctcttttcgtcctcaccttcttcactggtcccaacgtgtacgctctgaccgtctacgaggctcttcccgagtccatcacttcgctgctgcctgccagcttcctggacgtcaccatcacccagatctacattggattcggagtgctgggcatggtgttcaacatctacggcgcctgcggaaacgtgatcaagtactacaacaacaagggcaagagcgctctccccgccattctcggaatcgccccctttggcatcttctacgtcggcgtctttgcctgggcccatgttgctcctctgcttctctccaagtacgccatcgtctatctgtttgccattggggctgcctttgccatgcaagtcggccagatgattcttgcccatctcgtgcttgctccctttccccactggaacgtgctgctcttcttcccctttgtgggactggcagtgcactacattgcacccgtgtttggctgggacgccgatatcgtgtcggttaacactctcttcacctgttttggcgccaccctctccatttacgccttctttgtgcttgagatcatcgacgagatcaccaactacctcgatatctggtgtctgcgaatcaagtaccctcaggagaagaagaccgaataagcggccgcatggagcgtgtgttctgagtcgatgttttctatggagttgtgagtgttagtagacatgatgggtttatatatgatgaatgaatagatgtgattttgatttgcacgatggaattgagaactttgtaaacgtacatgggaatgtatgaatgtgggggttttgtgactggataactgacggtcagtggacgccgttgttcaaatatccaagagatgcgagaaactttgggtcaagtgaacatgtcctctctgttcaagtaaaccatcaactatgggtagtatatttagtaaggacaagagttgagattctttggagtcctagaaacgtattttcgcgttccaagatcaaattagtagagtaatacgggcacgggaatccattcatagtctcaatcctgcaggtgagttaattaatcgagcttggcgtaatcatggtcatagctgtttcctgtgtgaaattgttatccgctcacaattccacacaacgtacgatagttagtagacaacaatcagaacatctccctccttatataatcacacaggccagaacgcgctaaactaaagcgctttggacactatgttacattggcattgattgaactgaaaccacagtctccctcgcctgaatcgagcaatggatgttgtcggaagtcaacttcactagaagagcggttctatgccttgtcaagatcatatcataaactcactctgtattaccccatctatagaacacttgttatgaatgggcggaaacattccgctatatgcacctttccacactaatgcaaagatgtgcatcttcaacgggtagtaagactggttccgacttccgttgcatggagagcaatgacctcgataatgcgaacatcccccacatatacactcttacacaggccaatataatctgtgcatttactaaatatttaagtctatgcacctgcttgatgaaaagcggcacggatggtatcatctagtttccgccaatccaagaaccaactgtgttggcagtggtgtagcccatggcacacagaccaaagatgaaaatacagacatcggcggttcgagccgtggtgcctcgagcaacacccttgtaatgcaaaagaggagggtaaatgtacaccagaggcacacatgcaaacgatccggtgagagcgacgaaccgatcgagatcgtcggcacctccccatgcaacaaaggcggtgacaaacacaaggaagaaccggaaaatgttcttctgccacttgatggtagagttgtacttgcctgatcgggtgaagagaccattctcgatgattcggatggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcttagaagtgaggattacaagaagcctctggatatcaatgatgaacgtactcagcggctggtcaagcatttcgaccgtcgaatcgacgaggtgttcacctttgacaagcgagggttcccaattgatcacgttctcgagttgttcaaatcttctctcaacatctctctgcatgaactatctctgttgacgaacgtgtcacccactgttcctcgaacgcccttctccgagtttggtctgaacatcttcgatctcaaactgacccccgcagtgatcaatagtgccatgccactgccgatgcggtgcgaacatccctggagggattctcggagctctacacaatgcagattctgtcgtcgagtactctctaccttgctcgaatgacttattgtgctactactgcactcatgcttcgatcatgtgccctactgcaccccaaatttggtgatctgattgagacagagtaccctcttcagctgattcagaagatcatcagcaacatgaatgatgtggttgaccaggcaggctgttgtagtcacgtccttcacttcaagttcattcttcatctgcttctgttttactttgacaggcaaatgaagacatggtacgacttgatggaggccaagaacgccatttcaccccgagacaccgaagtgcctgaaatcctggctgcccccattgataacatcggaaactacggtattccggaaagtgtatatagaacctttccccagcttgtgtctgtggatatggatggtgtaatccccttaattaactcacctgcaggattgagactatgaatggattcccgtgcccgtattactctactaatttgatcttggaacgcgaaaatacgtttctaggactccaaagaatctcaactcttgtccttactaaatatactacccatagttgatggtttacttgaacagagaggacatgttcacttgacccaaagtttctcgcatctcttggatatttgaacaacggcgtccactgaccgtcagttatccagtcacaaaacccccacattcatacattcccatgtacgtttacaaagttctcaattccatcgtgcaaatcaaaatcacatctattcattcatcatatataaacccatcatgtctactaacactcacaactccatagaaaacatcgactcagaacacacgctccatgcggccgcttaggcaacgggcttgatgacagcgggaggagtgcccacattgtttcggtttcgaaagaacaggacacccttgccagctccctcggcaccagcggagggttcaacccactggcacattcgtgcagatcggtacatggctcgaatgaatcctcgaggaccgtcctggacatcagctcgatagtgcttgcccatgataggtttgatggcctcggtagcttcgtccgcattgtagaagggaatggaagagacgtagtgatgcaggacgtgagtctcgataatgccgtggagcagatgacgtccaatgaagcccatctctcggtcgatggttgcagcggcacctcgcacaaagttccactcgtcgttggtgtagtggggaagagtaggatctgtgtgctgcagaaaggtaatggcgacgagccagtggttaacccacaagtagggaacgaagtaccagatggccatgttgtagaatccgaacttctgaacgagaaagtacagagcggtggccataagaccaatgccaatgtcggagagcacgatgagcttggcgtcgctgttctcgtacagaggagatcggggatcgaaatggttaactccaccgccaagaccgttgtgctttcccttgcctcgaccctctcgctgccgctcatggtagttgtgtccagtaacgttggtaatgagatagttgggccaaccgaccagttgctgaagcacaagcatgagcagggtgaaagcaggagtttcctcggtaagatgggcgagttcgtgggtcatcttgccgagtcgagtagcttgctgctctcgggttcgaggaacgaagaccatgtctcgctccatgtttccagtggccttgtgatgcttccggtgggagatttgccagctgaagtagggaacaagcagggaagagtgaagcacccagccagtaatgtcgttgatgattcgggaatcggagaaagcaccatgtccacactcgtgggcaatgacccacagtccagtaccgaagagtccctgaagaacggtgtacacagcccacagaccggctcgagcaggagtggagggaatgtactcgggtgtcacaaagttgtaccagatgctgaaagtggtagtcaggaggacaatgtctcgaagaatgtagccgtatcccttgagagcagatcgcttgaagcagtgcttgggaatagcgttgtagatgtccttgatggtgaagtcgggaacttcgaactggttgccgtaggtatccagcatgacaccgtactcggacttgggcttggcaatgtccacctcggacatggaagacagcgatgtagaggaggccgagtgtctgggagaatcggagggagagacggcagcagactccgagtcggtcacagtggtggaagtgacggttcgtcggagggcagggttctgcttgggcagagccgaggtggaggccatggccattgctgtagatatgtcttgtgtgtaagggggttggggtggttgtttgtgttcttgacttttgtgttagcaagggaagacgggcaaaaaagtgagtgtggttgggagggagagacgagccttatatataatgcttgtttgtgtttgtgcaagtggacgccgaaacgggcaggagccaaactaaacaaggcagacaatgcgagcttaattggattgcctgatgggcaggggttagggctcgatcaatgggggtgcgaagtgacaaaattgggaattaggttcgcaagcaaggctgacaagactttggcccaaacatttgtacgcggtggacaacaggagccacccatcgtctgtcacgggctagccggtcgtgcgtcctgtcaggctccacctaggctccatgccactccatacaatcccactagtgtaccgctaggccgcttttagctcccatctaagacccccccaaaacctccactgtacagtgcactgtactgtgtggcgatcaagggcaagggaaaaaaggcgcaaacatgcacgcatggaatgacgtaggtaaggcgttactagactgaaaagtggcacatttcggcgtgccaaagggtcctaggtgcgtttcgcgagctgggcgccaggccaagccgctccaaaacgcctctccgactccctccagcggcctccatatccccatccctctccacagcaatgttgttaagccttgcaaacgaaaaaatagaaaggctaataagcttccaatattgtggtgtacgctgcataacgcaacaatgagcgccaaacaacacacacacacagcacacagcagcattaaccacgatgaacagcatgaattcctttacctgcaggataacttcgtataatgtatgctatacgaagttatgatctctctcttgagcttttccataacaagttcttctgcctccaggaagtccatgggtggtttgatcatggttttggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgcgataacttcgtataatgtatgctatacgaagttatcgtacgatagttagtagacaacaatcgatcgaggaagaggacaagcggctgcttcttaagtttgtgacatcagtatccaaggcaccattgcaaggattcaaggctttgaacccgtcatttgccattcgtaacgctggtagacaggttgatcggttccctacggcctccacctgtgtcaatcttctcaagctgcctgactatcaggacattgatcaacttcggaagaaacttttgtatgccattcgatcacatgctggtttcgatttgtcttagaggaacgcatatacagtaatcatagagaataaacgatattcatttattaaagtagatagttgaggtagaagttgtaaagagtgataaatagcggccgctcactgaatctttttggctcccttgtgctttcggacgatgtaggtctgcacgtagaagttgaggaacagacacaggacagtaccaacgtagaagtagttgaaaaaccagccaaacattctcattccatcttgtcggtagcagggaatgttccggtacttccagacgatgtagaagccaacgttgaactgaatgatctgcatagaagtaatcagggacttgggcatagggaacttgagcttgatcagtcgggtccaatagtagccgtacatgatccagtgaatgaagccgttgagcagcacaaagatccaaacggcttcgtttcggtagttgtagaacagccacatgtccataggagctccgagatggtgaaagaactgcaaccaggtcagaggcttgcccatgaggggcagatagaaggagtcaatgtactcgaggaacttgctgaggtagaacagctgagtggtgattcggaagacattgttgtcgaaagccttctcgcagttgtcggacatgacaccaatggtgtacatggcgtaggccatagagaggaaggagcccagcgagtagatggacatgagcaggttgtagttggtgaacacaaacttcattcgagactgacccttgggtccgagaggaccaagggtgaacttcaggatgacgaaggcgatggagaggtacagcacctcgcagtgcgaggcatcagaccagagctgagcatagtcgaccttgggaagaacctcctggccaatggagacgatttcgttcacgacctccatggttgtgaattagggtggtgagaatggttggttgtagggaagaatcaaaggccggtctcgggatccgtgggtatatatatatatatatatatatacgatccttcgttacctccctgttctcaaaactgtggtttttcgtttttcgttttttgctttttttgatttttttagggccaactaagcttccagatttcgctaatcacctttgtactaattacaagaaaggaagaagctgattagagttgggctttttatgcaactgtgctactccttatctctgatatgaaagtgtagacccaatcacatcatgtcatttagagttggtaatactgggaggatagataaggcacgaaaacgagccatagcagacatgctgggtgtagccaagcagaagaaagtagatgggagccaattgacgagcgagggagctacgccaatccgacatacgacacgctgagatcgtcttggccggggggtacctacagatgtccaagggtaagtgcttgactgtaattgtatgtctgaggacaaatatgtagtcagccgtataaagtcataccaggcaccagtgccatcatcgaaccactaactctctatgatacatgcctccggtattattgtaccatgcgtcgctttgttacatacgtatcttgcctttttctctcagaaactccagactttggctattggtcgagataagcccggaccatagtgagtctttcacactctgtttaaacaccactaaaaccccacaaaatatatcttaccgaatatacagatctactatagaggaacaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctccatggtgaaggcttctcgacaggctctgcccctcgtcatcgacggaaaggtgtacgacgtctccgcttgggtgaacttccaccctggtggagctgaaatcattgagaactaccagggacgagatgctactgacgccttcatggttatgcactctcaggaagccttcgacaagctcaagcgaatgcccaagatcaaccaggcttccgagctgcctccccaggctgccgtcaacgaagctcaggaggatttccgaaagctccgagaagagctgatcgccactggcatgtttgacgcctctcccctctggtactcgtacaagatcttgaccaccctgggtcttggcgtgcttgccttcttcatgctggtccagtaccacctgtacttcattggtgctctcgtgctcggtatgcactaccagcaaatgggatggctgtctcatgacatctgccaccaccagaccttcaagaaccgaaactggaataacgtcctgggtctggtctttggcaacggactccagggcttctccgtgacctggtggaaggacagacacaacgcccatcattctgctaccaacgttcagggtcacgatcccgacattgataacctgcctctgctcgcctggtccgaggacgatgtcactcgagcttctcccatctcccgaaagctcattcagttccaacagtactatttcctggtcatctgtattctcctgcgattcatctggtgtttccagtctgtgctgaccgttcgatccctcaaggaccgagacaaccagttctaccgatctcagtacaagaaagaggccattggactcgctctgcactggactctcaagaccctgttccacctcttctttatgccctccatcctgacctcgatgctggtgttctttgtttccgagctcgtcggtggcttcggaattgccatcgtggtcttcatgaaccactaccctctggagaagatcggtgattccgtctgggacggacatggcttctctgtgggtcagatccatgagaccatgaacattcgacgaggcatcattactgactggttctttggaggcctgaactaccagatcgagcaccatctctggcccaccctgcctcgacacaacctcactgccgtttcctaccaggtggaacagctgtgccagaagcacaacctcccctaccgaaaccctctgccccatgaaggtctcgtcatcctgctccgatacctgtcccagttcgctcgaatggccgagaagcagcccggtgccaaggctcagtaagcggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaattt

SEQ ID NO: 353 - DNA, 4313 bp, Artificial Sequence
  Plasmid pZKUM
taatcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgacgagtatctgtctgactcgtcattgccgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtacccggaaccggaatcgattgctggcctgcgagctggtgcgtacgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgacttaat

SEQ ID NO: 354 - DNA, 1459 bp, Artificial Sequence
  Synthetic mutant Ura3 gene, comprising a 33 bp deletion from +21 to +53, a  1 bp deletion at +376 and a 3 bp deletion from +400 to 403 of the Yarrowia Ura3 coding region (GenBank Accession No. AJ306421)
gagtatctgtctgactcgtcattgccgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtacccggaaccggaatcgattgctggcctgcgagctggtgcgtacgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgac

SEQ ID NO: 355 - DNA, 15966 bp, Artificial Sequence
  Plasmid pZKD2-5U89A2
gtacgtttcatgaaggcgggcagaaagtactcgatggtggagatgattgctcggaggtacttgttctgcggccagtatctctcagcaatcaggtgatactcctggacgtccagagggtagtatgtgtgcgtgggctccagatccaccgtcttgtgcagagttatggggaagtagcggccaaagagcttccagatgaagaagtttcttgaaataggcgagtatcgcttgaccactcctccgttggacggggagtcgtctttaacagcgtacactacatacgcaatcacaaatggccagagcagtggaattgcgcagcatagcatgaaaattgtgaggaaagtgggaatgctgaaaatgtgccagaccagagagaaggtctcacatcggttgagtaatggtgtcgatagcggggcatatcggattcccgcgattttgggtgccgtgtcgtttttgtctcgcgacttgtagtattgtgagtcgatagtcatagcttttgttttgtgtgacttgtctgttgcctgttgttagaagaaaaagtgggagcttatcagtcacggtccacgaacgatttcgtacttgtacgtaattggtcgtgagaactgttgcagagccggtgcttttttttgtggccaagtcgacaggtcgatttcggcgctgtgcgaggttgctgggatgtgctggtttggctgccaaatgtggggaagatttcaacctcggatttgacgtgtgtagaggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcatcaaaggaagggtgaatccaaggaagttcttgacaaactgctggaatcggtacagcttggacgacttgtcgttgctaacctggtcatagaggtcgttctcaccaaaggccatgatgggaacaagggcgacatttccgacctccataccaagtcgaacaaaaccctttcgcttgagtagcaccaggtccatgacaccgggtctggccagaagactttcctgtgctccaccaacgacaatgcagatagactggtttcgcttgaggagggccttgcaggacttcttggagacagaagcgactcccagactcatgaggtactctctgtagagaggcactcggaagttgttggtgagagtcataagagaaacagggatgcccggaaagagcttggaccatccagctccctcggtggcaattccaccaaaggctcccatgccgataatgccgtgggggtggtagccgaagatgtattttctgccagtgggcttgagttttgtgggcgacagctgtgggtcgttttcgccaatgatctggttggcgtaggagttgagggacccgttaagaagcgtggaatcagatgcagtggagccagcagaggcggacgacaaaggtcgtcggttagtggtgccattgttgccgttgccgttaagttcggagcccgaggcgtggccgttggagccagatgattctccacggctatatctgctgtcgtggttaattaactcacctgcaggattgagactatgaatggattcccgtgcccgtattactctactaatttgatcttggaacgcgaaaatacgtttctaggactccaaagaatctcaactcttgtccttactaaatatactacccatagttgatggtttacttgaacagagaggacatgttcacttgacccaaagtttctcgcatctcttggatatttgaacaacggcgtccactgaccgtcagttatccagtcacaaaacccccacattcatacattcccatgtacgtttacaaagttctcaattccatcgtgcaaatcaaaatcacatctattcattcatcatatataaacccatcatgtctactaacactcacaactccatagaaaacatcgactcagaacacacgctccatgcggccgcttaggaatcctgagcgtccttgacacagtgaaccacaccgactttgtgcatgtacttgagggtggaaatgatgttgcccacaatggtagggtagaagacgtaccgaactccgtgtcgttcgcaacactctcggacagcttgctgcacgaagggatagtgccaagacgacattcgaggaaagaggtgatgctcgatctggaagttgagaccgccagtaaagaacatggcaatgggtccaccgtaggtggaagaggtctccacctgagctctgtaccagtcgatctgatcggcttcaacgtccttctcggagctcttgaccttgcagttcttgtcggggattcgctccgagccatcgaagttgtgagacaagatgaaaaagaaggtgaggaaggcaccggtagcagtgggcaccagaggaatggtgatgagcagggaggttccagtgagataccagggcaagaaggcggttcgaaagatgaagaaagctcgcataacgaatgcaagggttcggtaccgtcgcagaaagccgttctctcgcatggctgtgacagactcgggaatggtgtcgttgtgctgcattcggaagatgtagagagggttgtacaccagcgaaacgccgtaggctccaagcacgaggtacatgtaccaggcctggaatcggtgaaaccactttcgagcagtgttggcagcagggtagttgtggaacacaaggaatggttctgcggactcggcatccaggtcgagaccatgctgattggtgtaggtgtgatgtcgcatgatgtgagactgcagccagatccatctggacgatccaatgacgtcgatgccgtaggcaaagagagcgttgacccagggctttttgctgatggcaccatgagaggcatcgtgctgaatggacaggccgatctgcatgtgcatgaatccagtcaagagaccccacagcaccattccggtagtagcccagtgccactcgcaaaaggcggtgacagcaatgatgccaacggttcgcagccagaatccaggtgtggcataccagttccgacctttcatgacctctcgcatagttcgcttgacgtcctgtgcaaagggagagtcgtaggtgtagacaatgtccttggaggttcggtcgtgcttgcctcgcacgaactgttgaagcagcttcgagttctcgggcttgacgtaagggtgcatggagtagaacagaggagaagcatcggaggcaccagaagcgaggatcaagtcgcctccgggatggaccttggcaagaccttccagatcgtagagaatgccgtcgatggcaaccaggtcgggtcgctcgagcagctgctcggtagtaagggagagagccatggccattgctgtagatatgtcttgtgtgtaagggggttggggtggttgtttgtgttcttgacttttgtgttagcaagggaagacgggcaaaaaagtgagtgtggttgggagggagagacgagccttatatataatgcttgtttgtgtttgtgcaagtggacgccgaaacgggcaggagccaaactaaacaaggcagacaatgcgagcttaattggattgcctgatgggcaggggttagggctcgatcaatgggggtgcgaagtgacaaaattgggaattaggttcgcaagcaaggctgacaagactttggcccaaacatttgtacgcggtggacaacaggagccacccatcgtctgtcacgggctagccggtcgtgcgtcctgtcaggctccacctaggctccatgccactccatacaatcccactagtgtaccgctaggccgcttttagctcccatctaagacccccccaaaacctccactgtacagtgcactgtactgtgtggcgatcaagggcaagggaaaaaaggcgcaaacatgcacgcatggaatgacgtaggtaaggcgttactagactgaaaagtggcacatttcggcgtgccaaagggtcctaggtgcgtttcgcgagctgggcgccaggccaagccgctccaaaacgcctctccgactccctccagcggcctccatatccccatccctctccacagcaatgttgttaagccttgcaaacgaaaaaatagaaaggctaataagcttccaatattgtggtgtacgctgcataacgcaacaatgagcgccaaacaacacacacacacagcacacagcagcattaaccacgatgaacagcatgaattctctctcttgagcttttccataacaagttcttctgcctccaggaagtccatgggtggtttgatcatggttttggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgaccttttccttgggaaccaccaccgtcagcccttctgactcacgtattgtagccaccgacacaggcaacagtccgtggatagcagaatatgtcttgtcggtccatttctcaccaactttaggcgtcaagtgaatgttgcagaagaagtatgtgccttcattgagaatcggtgttgctgatttcaataaagtcttgagatcagtttggccagtcatgttgtggggggtaattggattgagttatcgcctacagtctgtacaggtatactcgctgcccactttatactttttgattccgctgcacttgaagcaatgtcgtttaccaaaagtgagaatgctccacagaacacaccccagggtatggttgagcaaaaaataaacactccgatacggggaatcgaaccccggtctccacggttctcaagaagtattcttgatgagagcgtatcgatagttggagcaagggagaaatgtagagtgtgaaagactcactatggtccgggcttatctcgaccaatagccaaagtctggagtttctgagagaaaaaggcaagatacgtatgtaacaaagcgacgcatggtacaataataccggaggcatgtatcatagagagttagtggttcgatgatggcactggtgcctggtatgactttatacggctgactacatatttgtcctcagacatacaattacagtcaagcacttacccttggacatctgtaggtaccccccggccaagacgatctcagcgtgtcgtatgtcggattggcgtagctccctcgctcgtcaattggctcccatctactttcttctgcttggctacacccagcatgtctgctatggctcgttttcgtgccttatctatcctcccagtattaccaactctaaatgacatgatgtgattgggtctacactttcatatcagagataaggagtagcacagttgcataaaaagcccaactctaatcagcttcttcctttcttgtaattagtacaaaggtgattagcgaaatctggaagcttagttggccctaaaaaaatcaaaaaaagcaaaaaacgaaaaacgaaaaaccacagttttgagaacagggaggtaacgaaggatcgtatatatatatatatatatatatacccacggatcccgagaccggcctttgattcttccctacaaccaaccattctcaccaccctaattcacaaccatggctgccgtcatcgaggtggccaacgagttcgtcgctatcactgccgagacccttcccaaggtggactatcagcgactctggcgagacatctactcctgcgagctcctgtacttctccattgctttcgtcatcctcaagtttacccttggcgagctctcggattctggcaaaaagattctgcgagtgctgttcaagtggtacaacctcttcatgtccgtcttttcgctggtgtccttcctctgtatgggttacgccatctacaccgttggactgtactccaacgaatgcgacagagctttcgacaacagcttgttccgatttgccaccaaggtcttctactattccaagtttctggagtacatcgactctttctaccttcccctcatggccaagcctctgtcctttctgcagttctttcatcacttgggagctcctatggacatgtggctcttcgtgcagtactctggcgaatccatttggatctttgtgttcctgaacggattcattcactttgtcatgtacggctactattggacacggctgatgaagttcaactttcccatgcccaagcagctcattaccgcaatgcagatcacccagttcaacgttggcttctacctcgtgtggtggtacaaggacattccctgttaccgaaaggatcccatgcgaatgctggcctggatcttcaactactggtacgtcggtaccgttcttctgctcttcatcaacttctttgtcaagtcctacgtgtttcccaagcctaagactgccgacaaaaaggtccagtagcggccgcatgtacatacaagattatttatagaaatgaatcgcgatcgaacaaagagtacgagtgtacgagtaggggatgatgataaaagtggaagaagttccgcatctttggatttatcaacgtgtaggacgatacttcctgtaaaaatgcaatgtctttaccataggttctgctgtagatgttattaactaccattaacatgtctacttgtacagttgcagaccagttggagtatagaatggtacacttaccaaaaagtgttgatggttgtaactacgatatataaaactgttgacgggatctgtatattcggtaagatatattttgtggggttttagtggtgtttaaacaccactaaaaccccacaaaatatatcttaccgaatatacagatctactatagaggaacaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctccatggtgaaggcttctcgacaggctctgcccctcgtcatcgacggaaaggtgtacgacgtctccgcttgggtgaacttccaccctggtggagctgaaatcattgagaactaccagggacgagatgctactgacgccttcatggttatgcactctcaggaagccttcgacaagctcaagcgaatgcccaagatcaaccaggcttccgagctgcctccccaggctgccgtcaacgaagctcaggaggatttccgaaagctccgagaagagctgatcgccactggcatgtttgacgcctctcccctctggtactcgtacaagatcttgaccaccctgggtcttggcgtgcttgccttcttcatgctggtccagtaccacctgtacttcattggtgctctcgtgctcggtatgcactaccagcaaatgggatggctgtctcatgacatctgccaccaccagaccttcaagaaccgaaactggaataacgtcctgggtctggtctttggcaacggactccagggcttctccgtgacctggtggaaggacagacacaacgcccatcattctgctaccaacgttcagggtcacgatcccgacattgataacctgcctctgctcgcctggtccgaggacgatgtcactcgagcttctcccatctcccgaaagctcattcagttccaacagtactatttcctggtcatctgtattctcctgcgattcatctggtgtttccagtctgtgctgaccgttcgatccctcaaggaccgagacaaccagttctaccgatctcagtacaagaaagaggccattggactcgctctgcactggactctcaagaccctgttccacctcttctttatgccctccatcctgacctcgatgctggtgttctttgtttccgagctcgtcggtggcttcggaattgccatcgtggtcttcatgaaccactaccctctggagaagatcggtgattccgtctgggacggacatggcttctctgtgggtcagatccatgagaccatgaacattcgacgaggcatcattactgactggttctttggaggcctgaactaccagatcgagcaccatctctggcccaccctgcctcgacacaacctcactgccgtttcctaccaggtggaacagctgtgccagaagcacaacctcccctaccgaaaccctctgccccatgaaggtctcgtcatcctgctccgatacctgtcccagttcgctcgaatggccgagaagcagcccggtgccaaggctcagtaagcggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaatttaaatagttggagcaagggagaaatgtagagtgtgaaagactcactatggtccgggcttatctcgaccaatagccaaagtctggagtttctgagagaaaaaggcaagatacgtatgtaacaaagcgacgcatggtacaataataccggaggcatgtatcatagagagttagtggttcgatgatggcactggtgcctggtatgactttatacggctgactacatatttgtcctcagacatacaattacagtcaagcacttacccttggacatctgtaggtaccccccggccaagacgatctcagcgtgtcgtatgtcggattggcgtagctccctcgctcgtcaattggctcccatctactttcttctgcttggctacacccagcatgtctgctatggctcgttttcgtgccttatctatcctcccagtattaccaactctaaatgacatgatgtgattgggtctacactttcatatcagagataaggagtagcacagttgcataaaaagcccaactctaatcagcttcttcctttcttgtaattagtacaaaggtgattagcgaaatctggaagcttagttggccctaaaaaaatcaaaaaaagcaaaaaacgaaaaacgaaaaaccacagttttgagaacagggaggtaacgaaggatcgtatatatatatatatatatatatacccacggatcccgagaccggcctttgattcttccctacaaccaaccattctcaccaccctaattcacaaccatggcctccacctcggctctgcccaagcagaaccctgccctccgacgaaccgtcacttccaccactgtgaccgactcggagtctgctgccgtctctccctccgattctcccagacactcggcctcctctacatcgctgtcttccatgtccgaggtggacattgccaagcccaagtccgagtacggtgtcatgctggatacctacggcaaccagttcgaagttcccgacttcaccatcaaggacatctacaacgctattcccaagcactgcttcaagcgatctgctctcaagggatacggctacattcttcgagacattgtcctcctgactaccactttcagcatctggtacaactttgtgacacccgagtacattccctccactcctgctcgagccggtctgtgggctgtgtacaccgttcttcagggactcttcggtactggactgtgggtcattgcccacgagtgtggacatggtgctttctccgattcccgaatcatcaacgacattactggctgggtgcttcactcttccctgcttgttccctacttcagctggcaaatctcccaccggaagcatcacaaggccactggaaacatggagcgagacatggtcttcgttcctcgaacccgagagcagcaagctactcgactcggcaagatgacccacgaactcgcccatcttaccgaggaaactcctgctttcaccctgctcatgcttgtgcttcagcaactggtcggttggcccaactatctcattaccaacgttactggacacaactaccatgagcggcagcgagagggtcgaggcaagggaaagcacaacggtcttggcggtggagttaaccatttcgatccccgatctcctctgtacgagaacagcgacgccaagctcatcgtgctctccgacattggcattggtcttatggccaccgctctgtactttctcgttcagaagttcggattctacaacatggccatctggtacttcgttccctacttgtgggttaaccactggctcgtcgccattacctttctgcagcacacagatcctactcttccccactacaccaacgacgagtggaactttgtgcgaggtgccgctgcaaccatcgaccgagagatgggcttcattggacgtcatctgctccacggcattatcgagactcacgtcctgcatcactacgtctcttccattcccttctacaatgcggacgaagctaccgaggccatcaaacctatcatgggcaagcactatcgagctgatgtccaggacggtcctcgaggattcattcgagccatgtaccgatctgcacgaatgtgccagtgggttgaaccctccgctggtgccgagggagctggcaagggtgtcctgttctttcgaaaccgaaacaatgtgggcactcctcccgctgtcatcaagcccgttgcctaagcggccgctatttatcactctttacaacttctacctcaactatctactttaataaatgaatatcgtttattctctatgattactgtatatgcgttcctctaagacaaatcgaaaccagcatgtgatcgaatggcatacaaaagtttcttccgaagttgatcaatgtcctgatagtcaggcagcttgagaagattgacacaggtggaggccgtagggaaccgatcaacctgtctaccagcgttacgaatggcaaatgacgggttcaaagccttgaatccttgcaatggtgccttggatactgatgtcacaaacttaagaagcagccgcttgtcctcttcctcgatcgatggtcatagctgtttcctgtgtgaaattgttatccgctcacaattccacacaac

SEQ ID NO: 356 - DNA, 2119 bp, Yarrowia lipolytica
  CDS (291)..(1835): DGAT2 opening reading frame, comprising 2 smaller internal opening reading frames
  misc_feature (291)..(293): initiation codon ('ATG')
  misc_feature (456)..(458): initiation codon ('ATG')
  misc_feature (768)..(770): initiation codon ('ATG')
aaacgcacccactgctcgtcctccttgctcctcgaaaccgactcctctacacacgtcaaatccgaggttgaaatcttccccacatttggcagccaaaccagcacatcccagcaacctcgcacagcgccgaaatcgacctgtcgacttggccacaaaaaaaagcaccggctctgcaacagttctcacgaccaattacgtacaagtacgaaatcgttcgtggaccgtgactgataagctcccactttttcttctaacaacaggcaacagacaagtcacacaaaacaaaagctatgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatctccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaatggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctctacagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaaggaaaactgcctgggttaggcaaatagctaatgagtatttttttgatggcaaccaaatgtagaaagaaaaaaaaaaaaaaagaaaaaaaaaagagaatattatatctatgtaattctattaaaagctctgttgagtgagcggaataaatactgttgaagaggggattgtgtagagatctgtttactcaatggcaaactcatctgggggagatccttccactgtgggaagctcctggatagcctttgcatcggggttcaagaagaccattgtgaacagcccttga

SEQ ID NO: 357 - protein, 514 aa, Yarrowia lipolytica
MTIDSQYYKSRDKNDTAPKIAGIRYAPLSTPLLNRCETFSLVWHIFSIPTFLTIFMLCCAIPLLWPFVIAYVVYAVKDDSPSNGGVVKRYSPISRNFFIWKLFGRYFPITLHKTVDLEPTHTYYPLDVQEYHLIAERYWPQNKYLRAIISTIEYFLPAFMKRSLSINEQEQPAERDPLLSPVSPSSPGSQPDKWINHDSRYSRGESSGSNGHASGSELNGNGNNGTTNRRPLSSASAGSTASDSTLLNGSLNSYANQIIGENDPQLSPTKLKPTGRKYIFGYHPHGIIGMGAFGGIATEGAGWSKLFPGIPVSLMTLTNNFRVPLYREYLMSLGVASVSKKSCKALLKRNQSICIVVGGAQESLLARPGVMDLVLLKRKGFVRLGMEVGNVALVPIMAFGENDLYDQVSNDKSSKLYRFQQFVKNFLGFTLPLMHARGVFNYDVGLVPYRRPVNIVVGSPIDLPYLPHPTDEEVSEYHDRYIAELQRIYNEHKDEYFIDWTEEGKGAPEFRMIE

SEQ ID NO: 358 - DNA, 792 bp, Eutreptiella sp. CCMP389
  CDS (1)..(792): synthetic delta-9 elongase (codon-optimized for Yarrowia lipolytica)
  ref <302>: TITLE: DELTA-9 ELONGASES AND THEIR USE IN MAKING POLYUNSATURATED FATTY ACIDS
  ref <310>: PATENT DOCUMENT NUMBER: WO 2007/061742
  ref <311>: PATENT FILING DATE: 2006-11-16
  ref <312>: PUBLICATION DATE: 2007-05-31
  ref <313>: RELEVANT RESIDUES IN SEQ ID NO: (1)..(792)
  ref <302>: TITLE: DELTA-9 ELONGASES AND THEIR USE IN MAKING POLYUNSATURATED FATTY ACIDS
  ref <310>: PATENT DOCUMENT NUMBER: US 2007-0117190-A1
  ref <311>: PATENT FILING DATE: 2006-11-16
  ref <312>: PUBLICATION DATE: 2007-05-24
  ref <313>: RELEVANT RESIDUES IN SEQ ID NO: (1)..(792)
atggctgccgtcatcgaggtggccaacgagttcgtcgctatcactgccgagacccttcccaaggtggactatcagcgactctggcgagacatctactcctgcgagctcctgtacttctccattgctttcgtcatcctcaagtttacccttggcgagctctcggattctggcaaaaagattctgcgagtgctgttcaagtggtacaacctcttcatgtccgtcttttcgctggtgtccttcctctgtatgggttacgccatctacaccgttggactgtactccaacgaatgcgacagagctttcgacaacagcttgttccgatttgccaccaaggtcttctactattccaagtttctggagtacatcgactctttctaccttcccctcatggccaagcctctgtcctttctgcagttctttcatcacttgggagctcctatggacatgtggctcttcgtgcagtactctggcgaatccatttggatctttgtgttcctgaacggattcattcactttgtcatgtacggctactattggacacggctgatgaagttcaactttcccatgcccaagcagctcattaccgcaatgcagatcacccagttcaacgttggcttctacctcgtgtggtggtacaaggacattccctgttaccgaaaggatcccatgcgaatgctggcctggatcttcaactactggtacgtcggtaccgttcttctgctcttcatcaacttctttgtcaagtcctacgtgtttcccaagcctaagactgccgacaaaaaggtccagtag

SEQ ID NO: 359 - protein, 263 aa, Eutreptiella sp. CCMP389
MAAVIEVANEFVAITAETLPKVDYQRLWRDIYSCELLYFSIAFVILKFTLGELSDSGKKILRVLFKWYNLFMSVFSLVSFLCMGYAIYTVGLYSNECDRAFDNSLFRFATKVFYYSKFLEYIDSFYLPLMAKPLSFLQFFHHLGAPMDMWLFVQYSGESIWIFVFLNGFIHFVMYGYYWTRLMKFNFPMPKQLITAMQITQFNVGFYLVWWYKDIPCYRKDPMRMLAWIFNYWYVGTVLLLFINFFVKSYVFPKPKTADKKVQ

SEQ ID NO: 360 - DNA, 7904 bp, Artificial Sequence
  Plasmid pZuFmEgC20ES
catggctgactctcccgtcatcaacctctccaccatgtggaagcctctgtcgctcatggccttggatcttgctgttctgggacacgtctggaagcaggcacaacaggagggctccatctcggcttacgccgactctgtgtggactcccctcatcatgtccggtctgtacctctccatgatcttcgtgggatgtcgatggatgaagaaccgagagcccttcgaaatcaagacctacatgtttgcctacaacctgtaccagaccctcatgaacctttgcattgtgctgggcttcctctaccaggtccacgctaccggtatgcgattctggggatctggcgtggaccgatcgcccaagggtctgggaattggctttttcatctatgcccattaccacaacaagtacgtcgagtacttcgacacactcttcatggtgctgcggaaaaagaacaaccagatttcctttcttcacgtctaccatcacgctctgctcacctgggcttggtttgccgtggtctacttcgctcctggaggtgacggctggtttggagcctgctacaattcctccattcatgtcctgatgtactcttactatctgcttgccaccttcggcatctcctgtccctggaaaaagatcctcacccagctgcaaatggttcagttctgcttttgcttcacccactcgatctacgtgtggatttgcggttccgaaatctaccctcgacccttgactgctctccagtccttcgtgatggtcaacatgctggttctctttggcaacttctacgtcaagcagtattctcagaagaatggaaagcccgagaacggtgccactcctgagaacggtgccaagcctcagccctgcgagaacggcaccgtcgagaagcgagagaacgacactgccaacgttcgataagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtac

SEQ ID NO: 361 - DNA, 7892 bp, Artificial Sequence
  Plasmid pZuFmEaC20ES
catggccgagggcaagtccgacggtcccgtcgttaccctccagtccatgtggaagcccctggctctcatggccatcgacgtcggcatcctggtcaacgtgcgacggaaggccttcaccgagttcgacggacactcgaacgtcttcgccgatcccgtgtacattccctttgtcatgaacctgttctacctcaccatgatctttgctggctgccgatggatgaagactcgagaacccttcgagatcaagtcctacatgtttgcctacaacgcttaccagacaatgatgaactttctcattgtggtcggcttcatgtatgaggttcactccaccggtatgcgatactggggatccagaatcgacacttctaccaagggcttgggactgggtttcctcatctatgcccattaccacaacaagtacgtggagtacgtcgacaccctgttcatgattctgcggaagaaaaacaatcagatctcgttccttcacgtttaccaccattccctgctcacttgggcatggtgggctgtggtctactgggctcctggcggagatgcctggttcggtgcctgttacaactccttcatccacgttctcatgtactcctactatctgtttgccaccttcggcattcgatgtccctggaaaaagatgctcacccagttgcaaatggtccagttctgcttttgcttcgctcatgccatgtacgttggatggcttggtcacgaggtgtaccctcgatggctcactgctctgcaggcctttgtgatgctcaacatgctggtcctctttggcaacttctacatgaagtcttactccaaggcgagcaagctcgaaccagcctctcccgtgtcgcctgcctctcttgctcagaagcccttcgagaacgccaaggtcaagtaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtac

SEQ ID NO: 362 - DNA, 13412 bp, Artificial Sequence
  Plasmid pZKL4-220EA4
aaacagagtgtgaaagactcactatggtccgggcttatctcgaccaatagccaaagtctggagtttctgagagaaaaaggcaagatacgtatgtaacaaagcgacgcatggtacaataataccggaggcatgtatcatagagagttagtggttcgatgatggcactggtgcctggtatgactttatacggctgactacatatttgtcctcagacatacaattacagtcaagcacttacccttggacatctgtaggtaccccccggccaagacgatctcagcgtgtcgtatgtcggattggcgtagctccctcgctcgtcaattggctcccatctactttcttctgcttggctacacccagcatgtctgctatggctcgttttcgtgccttatctatcctcccagtattaccaactctaaatgacatgatgtgattgggtctacactttcatatcagagataaggagtagcacagttgcataaaaagcccaactctaatcagcttcttcctttcttgtaattagtacaaaggtgattagcgaaatctggaagcttagttggccctaaaaaaatcaaaaaaagcaaaaaacgaaaaacgaaaaaccacagttttgagaacagggaggtaacgaaggatcgtatatatatatatatatatatatacccacggatcccgagaccggcctttgattcttccctacaaccaaccattctcaccaccctaattcacaaccatggctgactctcccgtcatcaacctctccaccatgtggaagcctctgtcgctcatggccttggatcttgctgttctgggacacgtctggaagcaggcacaacaggagggctccatctcggcttacgccgactctgtgtggactcccctcatcatgtccggtctgtacctctccatgatcttcgtgggatgtcgatggatgaagaaccgagagcccttcgaaatcaagacctacatgtttgcctacaacctgtaccagaccctcatgaacctttgcattgtgctgggcttcctctaccaggtccacgctaccggtatgcgattctggggatctggcgtggaccgatcgcccaagggtctgggaattggctttttcatctatgcccattaccacaacaagtacgtcgagtacttcgacacactcttcatggtgctgcggaaaaagaacaaccagatttcctttcttcacgtctaccatcacgctctgctcacctgggcttggtttgccgtggtctacttcgctcctggaggtgacggctggtttggagcctgctacaattcctccattcatgtcctgatgtactcttactatctgcttgccaccttcggcatctcctgtccctggaaaaagatcctcacccagctgcaaatggttcagttctgcttttgcttcacccactcgatctacgtgtggatttgcggttccgaaatctaccctcgacccttgactgctctccagtccttcgtgatggtcaacatgctggttctctttggcaacttctacgtcaagcagtattctcagaagaatggaaagcccgagaacggtgccactcctgagaacggtgccaagcctcagccctgcgagaacggcaccgtcgagaagcgagagaacgacactgccaacgttcgataagcggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaactccgagccgtgagtatccacgacaagatcagtgtcgagacgacgcgttttgtgtaatgacacaatccgaaagtcgctagcaacacacactctctacacaaactaacccagctctggtaccatggccgagggcaagtccgacggtcccgtcgttaccctccagtccatgtggaagcccctggctctcatggccatcgacgtcggcatcctggtcaacgtgcgacggaaggccttcaccgagttcgacggacactcgaacgtcttcgccgatcccgtgtacattccctttgtcatgaacctgttctacctcaccatgatctttgctggctgccgatggatgaagactcgagaacccttcgagatcaagtcctacatgtttgcctacaacgcttaccagacaatgatgaactttctcattgtggtcggcttcatgtatgaggttcactccaccggtatgcgatactggggatccagaatcgacacttctaccaagggcttgggactgggtttcctcatctatgcccattaccacaacaagtacgtggagtacgtcgacaccctgttcatgattctgcggaagaaaaacaatcagatctcgttccttcacgtttaccaccattccctgctcacttgggcatggtgggctgtggtctactgggctcctggcggagatgcctggttcggtgcctgttacaactccttcatccacgttctcatgtactcctactatctgtttgccaccttcggcattcgatgtccctggaaaaagatgctcacccagttgcaaatggtccagttctgcttttgcttcgctcatgccatgtacgttggatggcttggtcacgaggtgtaccctcgatggctcactgctctgcaggcctttgtgatgctcaacatgctggtcctctttggcaacttctacatgaagtcttactccaaggcgagcaagctcgaaccagcctctcccgtgtcgcctgcctctcttgctcagaagcccttcgagaacgccaaggtcaagtaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgtagggatcaggtgcttaggaagctcgaccaaccacggagactgttgaaactggatgtcggtaacagcatctggaatgctgaatgttcctcgaataacaacatatttctccttgttgaggtgatcataagctatgtatccggtgattgaagtggaatagaagtctcctccgaagactgagtccaacgtcatgttcgggaaataccgacaactctctccacatgtaaaatcagttcgtagaggagtgactggcgcattgacacagtaggcgatgtttgcaatccgagaaaacttggccgtaaagttgtacagctcctgggaggcttgaactcgagtttttgaaagtgtcgctggtggctcgccgaagagggaggcatagaggtacgcaaccacttgcccgagcgtgaggttcatgatgccaatagtgaatgtcatttatcaccgtactgcgcagtatttatatagggctcatcggtccatgtatagatctgtccacttatgacacccccatgtctcattaatgtgtaaaggtggagacgggtggagtacaggtacagagttggaggaaatcaggatagtggggttaagacatgctccgagtccaaatttcaactctccattgtcacaagacctctggtttcagagttattacagatctaggcctgtttcaaggtgaggggacctcatctggatcggcacgacgatcgtcaccttacagaggacgtctgtcgcagggaaaggtgatgtggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgccaaggcgtatattagttggtgggaaccagtgtacgaccgggtcctgtataaccaggttcagtggcatacttgtaggagttgttcccgtggtatttgggcatggctaagacatttcgccgaccaatgttaagtgcacaatagccgatgtagtagatgtaagccagatggttttggagcaggtcgattcgagaccacagattgaaagtgcctcgatggcaggcctcgttttctcctccttcacagacagacactttgtcgagtgcagggtagacgctttcttggtcaatgtacacttctccaatggcgtgtgtgtaattggaccaatctggcagtccaacgaagatatcgttccagtgggtgagcctgtagtttcgtcgcttgtcgtttacttcaaggcctgtgtcattaaaccacagctggttgatgtagtttgcaaactctgagtttcctactctcggctggccaaagttgatcatggtaggatcatgtccaagtaatttgaagtgagttgcgaaaagaagagcttgagcagcgcccagcgagtgaccagtaacatacattttgtagtcagtgtggttggtgaggaacttttcaaactgaggagcagcattgaccatagtttcgttgaaggccttggcgaacccatcatggatcatgcagcctttgcactcactagttttgatgggaataagacgggggtcttcaaccaccagagcccgctctttgaggttgtcaagacctttgttctccacttccaagtctggtcggactgcccatctctgttaattaagttgcgacacatgtcttgatagtatcttgaattctctctcttgagcttttccataacaagttcttctgcctccaggaagtccatgggtggtttgatcatggttttggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgaccttttccttgggaaccaccaccgtcagcccttctgactcacgtattgtagccaccgacacaggcaacagtccgtggatagcagaatatgtcttgtcggtccatttctcaccaactttaggcgtcaagtgaatgttgcagaagaagtatgtgccttcattgagaatcggtgttgctgatttcaataaagtcttgagatcagtttggccagtcatgttgtggggggtaattggattgagttatcgcctacagtctgtacaggtatactcgctgcccactttatactttttgattccgctgcacttgaagcaatgtcgtttaccaaaagtgagaatgctccacagaacacaccccagggtatggttgagcaaaaaataaacactccgatacggggaatcgaaccccggtctccacggttctcaagaagtattcttgatgagagcgtatcgatcgaggaagaggacaagcggctgcttcttaagtttgtgacatcagtatccaaggcaccattgcaaggattcaaggctttgaacccgtcatttgccattcgtaacgctggtagacaggttgatcggttccctacggcctccacctgtgtcaatcttctcaagctgcctgactatcaggacattgatcaacttcggaagaaacttttgtatgccattcgatcacatgctggtttcgatttgtcttagaggaacgcatatacagtaatcatagagaataaacgatattcatttattaaagtagatagttgaggtagaagttgtaaagagtgataaatagcggccgcttaagccagagtggcgacagcaggacaaccggcagcagatccgtcggtggagccgtcgggttgggcagcaacggcagcagagagcacaggacaaacatcctccagggaacctgcagtgggagcaagcttgtcgttgtctgcaggtttggtgcccatagctcgcaagtgctcgaccattccgtacagagcatcggaaaactgagagtagttcttgtagggaagaccgtattcctcgcacacgcccttgacaacaggagcaatggtgggatagttggcgtgagaaatgctgggaaacaggtgatgctcgatctggtggttgagtccaccagaaaggtggtttgaaaagtagccaccagatcgccagttgacgcaacacagaacttgggaggcagcccagtcgttgggaggtggagtggggtgcttctgtttcgccttggcttcctgctcggcctgcttgagcatttcggtccgtcgggcagcgataacggaagagggattgaggtagtcgcacgactcggaaatgtggttgataatgaaacagacggcaaggtactcgccagaaaccagatgagctgtaatgaagagggccaatccgtgagcgatgccatgcaggtagcagggaagcacaatctgcatgagaaagcccatgatctttgcaccccagaacagcatctgaccctcgaggggaacgagtctggcagagaagtcgatgggaccacgtcgcttggcaagacaaaacgtgaaatcggagataatgaccttgctgatggtcatgagagcgaacaacggaaaggcgtacacgtgttgcagctgatggtggggtttccaaggagtgtccggatgcatccgcatgaggggataggttccgaaaacgtctggatcgttctcgggaagagcaaactcgggatcggacaccaggttggtgtactggtgatgaccaatgacgtgttggtactcccaggcagtcgaggaggctccgataacgtccataccccagccagcaagacggttgagtcgtccagacttggagaaagcaccatgattgccgtcgtgctggatgctgagtccaatgtgagagcctgccagaccccagacggcagcccaaaagaaggatccctgtgtcaccatgaggtagaacgaggcagcaaaggcagccataacaagggctgccttgacagacaggccaccacgtcgaggttgtccagcctccttgagagtctgaaccactcgctgcttgagctcggcgtagaaagcggaggcctgccagtcgtagaaggttctgtgatcctgaagtgtaccgattcggtacttctccataaccttgtcgggtcgtcctgcaggatggtacgattcgaccagaatagtggagtctcgtccgagaccgagagagataacatctccaccgggatgcttgccaatgaactcggtgatgtcgtacacaccgtcgtgacaggccaaccagccatcggtgggaacaatgtgtcgagcgacctctcgcatggtaaactttcggtcctgtccagtaccggaggtggccagagcgtcgtaataggctgcaggtgggttgccaacaggtcgaatgggaggtggaagagaagcgatctccgagggcttgccaggtccaccgggtttgaccttggcgttctcgaatggcttctgagccagggatgcgggagacacaggggaagcgggttcgagcttcgaggccttggagtaagacttcatgtagaagttgccgaagagaacgaccatggccattgctgtagatatgtcttgtgtgtaagggggttggggtggttgtttgtgttcttgacttttgtgttagcaagggaagacgggcaaaaaagtgagtgtggttgggagggagagacgagccttatatataatgcttgtttgtgtttgtgcaagtggacgccgaaacgggcaggagccaaactaaacaaggcagacaatgcgagcttaattggattgcctgatgggcaggggttagggctcgatcaatgggggtgcgaagtgacaaaattgggaattaggttcgcaagcaaggctgacaagactttggcccaaacatttgtacgcggtggacaacaggagccacccatcgtctgtcacgggctagccggtcgtgcgtcctgtcaggctccacctaggctccatgccactccatacaatcccactagtgtaccgctaggccgcttttagctcccatctaagacccccccaaaacctccactgtacagtgcactgtactgtgtggcgatcaagggcaagggaaaaaaggcgcaaacatgcacgcatggaatgacgtaggtaaggcgttactagactgaaaagtggcacatttcggcgtgccaaagggtcctaggtgcgtttcgcgagctgggcgccaggccaagccgctccaaaacgcctctccgactccctccagcggcctccatatccccatccctctccacagcaatgttgttaagccttgcaaacgaaaaaatagaaaggctaataagcttccaatattgtggtgtacgctgcataacgcaacaatgagcgccaaacaacacacacacacagcacacagcagcattaaccacgatgttt

SEQ ID NO: 363 - DNA, 1221 bp, Yarrowia lipolytica
  misc_feature (1)..(1221): GenBank Accession No. XM_503825
atgacattcactattggcatcatgaacctcacgctcgggcaagtggttgcgtacctctatgcctccctcttcggcgagccaccagcgacactttcaaaaactcgagttcaagcctcccaggagctgtacaactttacggccaagttttctcggattgcaaacatcgcctactgtgtcaatgcgccagtcactcctctacgaactgattttacatgtggagagagttgtcggtatttcccgaacatgacgttggactcagtcttcggaggagacttctattccacttcaatcaccggatacatagcttatgatcacctcaacaaggagaaatatgttgttattcgaggaacattcagcattccagatgctgttaccgacatccagtttcaacagtctccgtggttggtcgagcttcctaagcacctgatccctacccaagacgatatgaaacagagatgggcagtccgaccagacttggaagtggagaacaaaggtcttgacaacctcaaagagcgggctctggtggttgaagacccccgtcttattcccatcaaaactagtgagtgcaaaggctgcatgatccatgatgggttcgccaaggccttcaacgaaactatggtcaatgctgctcctcagtttgaaaagttcctcaccaaccacactgactacaaaatgtatgttactggtcactcgctgggcgctgctcaagctcttcttttcgcaactcacttcaaattacttggacatgatcctaccatgatcaactttggccagccgagagtaggaaactcagagtttgcaaactacatcaaccagctgtggtttaatgacacaggccttgaagtaaacgacaagcgacgaaactacaggctcacccactggaacgatatcttcgttggactgccagattggtccaattacacacacgccattggagaagtgtacattgaccaagaaagcgtctaccctgcactcgacaaagtgtctgtctgtgaaggaggagaaaacgaggcctgccatcgaggcactttcaatctgtggtctcgaatcgacctgctccaaaaccatctggcttacatctactacatcggctattgtgcacttaacattggtcggcgaaatgtcttagccatgcccaaataccacgggaacaactcctacaagtatgccactgaacctggttatacaggacccggtcgtacactggttcccaccaactaa

SEQ ID NO: 364 - DNA, 8744 bp, Artificial Sequence
  Plasmid pZuFmEaD4S
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggtcgttctcttcggcaacttctacatgaagtcttactccaaggcctcgaagctcgaacccgcttcccctgtgtctcccgcatccctggctcagaagccattcgagaacgccaaggtcaaacccggtggacctggcaagccctcggagatcgcttctcttccacctcccattcgacctgttggcaacccacctgcagcctattacgacgctctggccacctccggtactggacaggaccgaaagtttaccatgcgagaggtcgctcgacacattgttcccaccgatggctggttggcctgtcacgacggtgtgtacgacatcaccgagttcattggcaagcatcccggtggagatgttatctctctcggtctcggacgagactccactattctggtcgaatcgtaccatcctgcaggacgacccgacaaggttatggagaagtaccgaatcggtacacttcaggatcacagaaccttctacgactggcaggcctccgctttctacgccgagctcaagcagcgagtggttcagactctcaaggaggctggacaacctcgacgtggtggcctgtctgtcaaggcagcccttgttatggctgcctttgctgcctcgttctacctcatggtgacacagggatccttcttttgggctgccgtctggggtctggcaggctctcacattggactcagcatccagcacgacggcaatcatggtgctttctccaagtctggacgactcaaccgtcttgctggctggggtatggacgttatcggagcctcctcgactgcctgggagtaccaacacgtcattggtcatcaccagtacaccaacctggtgtccgatcccgagtttgctcttcccgagaacgatccagacgttttcggaacctatcccctcatgcggatgcatccggacactccttggaaaccccaccatcagctgcaacacgtgtacgcctttccgttgttcgctctcatgaccatcagcaaggtcattatctccgatttcacgttttgtcttgccaagcgacgtggtcccatcgacttctctgccagactcgttcccctcgagggtcagatgctgttctggggtgcaaagatcatgggctttctcatgcagattgtgcttccctgctacctgcatggcatcgctcacggattggccctcttcattacagctcatctggtttctggcgagtaccttgccgtctgtttcattatcaaccacatttccgagtcgtgcgactacctcaatccctcttccgttatcgctgcccgacggaccgaaatgctcaagcaggccgagcaggaagccaaggcgaaacagaagcaccccactccacctcccaacgactgggctgcctcccaagttctgtgttgcgtcaactggcgatctggtggctacttttcaaaccacctttctggtggactcaaccaccagatcgagcatcacctgtttcccagcatttctcacgccaactatcccaccattgctcctgttgtcaagggcgtgtgcgaggaatacggtcttccctacaagaactactctcagttttccgatgctctgtacggaatggtcgagcacttgcgagctatgggcaccaaacctgcagacaacgacaagcttgctcccactgcaggttccctggaggatgtttgtcctgtgctctctgctgccgttgctgcccaacccgacggctccaccgacggatctgctgccggttgtcctgctgtcgccactctggcttaagc

SEQ ID NO: 365 - DNA, 7783 bp, Artificial Sequence; identical to SEQ ID NO: 33
  Plasmid pZuFmIgD9ES

SEQ ID NO: 366 - DNA, 39 bp, Artificial Sequence
  Primer YL921
tcagaagccattcgagccatggccaaggtcaaacccggt

SEQ ID NO: 367 - DNA, 39 bp, Artificial Sequence
  Primer YL922
accgggtttgaccttggccatggctcgaatggcttctga

SEQ ID NO: 368 - DNA, 36 bp, Artificial Sequence
  Primer YL923
ctcttccacctcccatggtccgacctgttggcaacc

SEQ ID NO: 369 - DNA, 36 bp, Artificial Sequence
  Primer YL924
ggttgccaacaggtcggaccatgggaggtggaagag

SEQ ID NO: 370 - DNA, 34 bp, Artificial Sequence
  Primer YL925
cagcctattacgacgccatggccacctccggtac

SEQ ID NO: 371 - DNA, 34 bp, Artificial Sequence
  Primer YL926
gtaccggaggtggccatggcgtcgtaataggctg

SEQ ID NO: 372 - DNA, 8746 bp, Artificial Sequence
  Plasmid pZuFmEaD4S-M1
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggtcgttctcttcggcaacttctacatgaagtcttactccaaggcctcgaagctcgaacccgcttcccctgtgtctcccgcatccctggctcagaagccattcgagccatggccaaggtcaaacccggtggacctggcaagccctcggagatcgcttctcttccacctcccattcgacctgttggcaacccacctgcagcctattacgacgctctggccacctccggtactggacaggaccgaaagtttaccatgcgagaggtcgctcgacacattgttcccaccgatggctggttggcctgtcacgacggtgtgtacgacatcaccgagttcattggcaagcatcccggtggagatgttatctctctcggtctcggacgagactccactattctggtcgaatcgtaccatcctgcaggacgacccgacaaggttatggagaagtaccgaatcggtacacttcaggatcacagaaccttctacgactggcaggcctccgctttctacgccgagctcaagcagcgagtggttcagactctcaaggaggctggacaacctcgacgtggtggcctgtctgtcaaggcagcccttgttatggctgcctttgctgcctcgttctacctcatggtgacacagggatccttcttttgggctgccgtctggggtctggcaggctctcacattggactcagcatccagcacgacggcaatcatggtgctttctccaagtctggacgactcaaccgtcttgctggctggggtatggacgttatcggagcctcctcgactgcctgggagtaccaacacgtcattggtcatcaccagtacaccaacctggtgtccgatcccgagtttgctcttcccgagaacgatccagacgttttcggaacctatcccctcatgcggatgcatccggacactccttggaaaccccaccatcagctgcaacacgtgtacgcctttccgttgttcgctctcatgaccatcagcaaggtcattatctccgatttcacgttttgtcttgccaagcgacgtggtcccatcgacttctctgccagactcgttcccctcgagggtcagatgctgttctggggtgcaaagatcatgggctttctcatgcagattgtgcttccctgctacctgcatggcatcgctcacggattggccctcttcattacagctcatctggtttctggcgagtaccttgccgtctgtttcattatcaaccacatttccgagtcgtgcgactacctcaatccctcttccgttatcgctgcccgacggaccgaaatgctcaagcaggccgagcaggaagccaaggcgaaacagaagcaccccactccacctcccaacgactgggctgcctcccaagttctgtgttgcgtcaactggcgatctggtggctacttttcaaaccacctttctggtggactcaaccaccagatcgagcatcacctgtttcccagcatttctcacgccaactatcccaccattgctcctgttgtcaagggcgtgtgcgaggaatacggtcttccctacaagaactactctcagttttccgatgctctgtacggaatggtcgagcacttgcgagctatgggcaccaaacctgcagacaacgacaagcttgctcccactgcaggttccctggaggatgtttgtcctgtgctctctgctgccgttgctgcccaacccgacggctccaccgacggatctgctgccggttgtcctgctgtcgccactctggcttaagc

SEQ ID NO: 373 - DNA, 8747 bp, Artificial Sequence
  Plasmid pZuFmEaD4S-M2
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggtcgttctcttcggcaacttctacatgaagtcttactccaaggcctcgaagctcgaacccgcttcccctgtgtctcccgcatccctggctcagaagccattcgagaacgccaaggtcaaacccggtggacctggcaagccctcggagatcgcttctcttccacctcccatggtccgacctgttggcaacccacctgcagcctattacgacgctctggccacctccggtactggacaggaccgaaagtttaccatgcgagaggtcgctcgacacattgttcccaccgatggctggttggcctgtcacgacggtgtgtacgacatcaccgagttcattggcaagcatcccggtggagatgttatctctctcggtctcggacgagactccactattctggtcgaatcgtaccatcctgcaggacgacccgacaaggttatggagaagtaccgaatcggtacacttcaggatcacagaaccttctacgactggcaggcctccgctttctacgccgagctcaagcagcgagtggttcagactctcaaggaggctggacaacctcgacgtggtggcctgtctgtcaaggcagcccttgttatggctgcctttgctgcctcgttctacctcatggtgacacagggatccttcttttgggctgccgtctggggtctggcaggctctcacattggactcagcatccagcacgacggcaatcatggtgctttctccaagtctggacgactcaaccgtcttgctggctggggtatggacgttatcggagcctcctcgactgcctgggagtaccaacacgtcattggtcatcaccagtacaccaacctggtgtccgatcccgagtttgctcttcccgagaacgatccagacgttttcggaacctatcccctcatgcggatgcatccggacactccttggaaaccccaccatcagctgcaacacgtgtacgcctttccgttgttcgctctcatgaccatcagcaaggtcattatctccgatttcacgttttgtcttgccaagcgacgtggtcccatcgacttctctgccagactcgttcccctcgagggtcagatgctgttctggggtgcaaagatcatgggctttctcatgcagattgtgcttccctgctacctgcatggcatcgctcacggattggccctcttcattacagctcatctggtttctggcgagtaccttgccgtctgtttcattatcaaccacatttccgagtcgtgcgactacctcaatccctcttccgttatcgctgcccgacggaccgaaatgctcaagcaggccgagcaggaagccaaggcgaaacagaagcaccccactccacctcccaacgactgggctgcctcccaagttctgtgttgcgtcaactggcgatctggtggctacttttcaaaccacctttctggtggactcaaccaccagatcgagcatcacctgtttcccagcatttctcacgccaactatcccaccattgctcctgttgtcaagggcgtgtgcgaggaatacggtcttccctacaagaactactctcagttttccgatgctctgtacggaatggtcgagcacttgcgagctatgggcaccaaacctgcagacaacgacaagcttgctcccactgcaggttccctggaggatgtttgtcctgtgctctctgctgccgttgctgcccaacccgacggctccaccgacggatctgctgccggttgtcctgctgtcgccactctggcttaagc

SEQ ID NO: 374 - DNA, 8744 bp, Artificial Sequence
  Plasmid pZuFmEaD4S-M3
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggtcgttctcttcggcaacttctacatgaagtcttactccaaggcctcgaagctcgaacccgcttcccctgtgtctcccgcatccctggctcagaagccattcgagaacgccaaggtcaaacccggtggacctggcaagccctcggagatcgcttctcttccacctcccattcgacctgttggcaacccacctgcagcctattacgacgccatggccacctccggtactggacaggaccgaaagtttaccatgcgagaggtcgctcgacacattgttcccaccgatggctggttggcctgtcacgacggtgtgtacgacatcaccgagttcattggcaagcatcccggtggagatgttatctctctcggtctcggacgagactccactattctggtcgaatcgtaccatcctgcaggacgacccgacaaggttatggagaagtaccgaatcggtacacttcaggatcacagaaccttctacgactggcaggcctccgctttctacgccgagctcaagcagcgagtggttcagactctcaaggaggctggacaacctcgacgtggtggcctgtctgtcaaggcagcccttgttatggctgcctttgctgcctcgttctacctcatggtgacacagggatccttcttttgggctgccgtctggggtctggcaggctctcacattggactcagcatccagcacgacggcaatcatggtgctttctccaagtctggacgactcaaccgtcttgctggctggggtatggacgttatcggagcctcctcgactgcctgggagtaccaacacgtcattggtcatcaccagtacaccaacctggtgtccgatcccgagtttgctcttcccgagaacgatccagacgttttcggaacctatcccctcatgcggatgcatccggacactccttggaaaccccaccatcagctgcaacacgtgtacgcctttccgttgttcgctctcatgaccatcagcaaggtcattatctccgatttcacgttttgtcttgccaagcgacgtggtcccatcgacttctctgccagactcgttcccctcgagggtcagatgctgttctggggtgcaaagatcatgggctttctcatgcagattgtgcttccctgctacctgcatggcatcgctcacggattggccctcttcattacagctcatctggtttctggcgagtaccttgccgtctgtttcattatcaaccacatttccgagtcgtgcgactacctcaatccctcttccgttatcgctgcccgacggaccgaaatgctcaagcaggccgagcaggaagccaaggcgaaacagaagcaccccactccacctcccaacgactgggctgcctcccaagttctgtgttgcgtcaactggcgatctggtggctacttttcaaaccacctttctggtggactcaaccaccagatcgagcatcacctgtttcccagcatttctcacgccaactatcccaccattgctcctgttgtcaagggcgtgtgcgaggaatacggtcttccctacaagaactactctcagttttccgatgctctgtacggaatggtcgagcacttgcgagctatgggcaccaaacctgcagacaacgacaagcttgctcccactgcaggttccctggaggatgtttgtcctgtgctctctgctgccgttgctgcccaacccgacggctccaccgacggatctgctgccggttgtcctgctgtcgccactctggcttaagc

SEQ ID NO: 375 - DNA, 8636 bp, Artificial Sequence
  Plasmid pZuFmEaD4S-1
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggccaaggtcaaacccggtggacctggcaagccctcggagatcgcttctcttccacctcccattcgacctgttggcaacccacctgcagcctattacgacgctctggccacctccggtactggacaggaccgaaagtttaccatgcgagaggtcgctcgacacattgttcccaccgatggctggttggcctgtcacgacggtgtgtacgacatcaccgagttcattggcaagcatcccggtggagatgttatctctctcggtctcggacgagactccactattctggtcgaatcgtaccatcctgcaggacgacccgacaaggttatggagaagtaccgaatcggtacacttcaggatcacagaaccttctacgactggcaggcctccgctttctacgccgagctcaagcagcgagtggttcagactctcaaggaggctggacaacctcgacgtggtggcctgtctgtcaaggcagcccttgttatggctgcctttgctgcctcgttctacctcatggtgacacagggatccttcttttgggctgccgtctggggtctggcaggctctcacattggactcagcatccagcacgacggcaatcatggtgctttctccaagtctggacgactcaaccgtcttgctggctggggtatggacgttatcggagcctcctcgactgcctgggagtaccaacacgtcattggtcatcaccagtacaccaacctggtgtccgatcccgagtttgctcttcccgagaacgatccagacgttttcggaacctatcccctcatgcggatgcatccggacactccttggaaaccccaccatcagctgcaacacgtgtacgcctttccgttgttcgctctcatgaccatcagcaaggtcattatctccgatttcacgttttgtcttgccaagcgacgtggtcccatcgacttctctgccagactcgttcccctcgagggtcagatgctgttctggggtgcaaagatcatgggctttctcatgcagattgtgcttccctgctacctgcatggcatcgctcacggattggccctcttcattacagctcatctggtttctggcgagtaccttgccgtctgtttcattatcaaccacatttccgagtcgtgcgactacctcaatccctcttccgttatcgctgcccgacggaccgaaatgctcaagcaggccgagcaggaagccaaggcgaaacagaagcaccccactccacctcccaacgactgggctgcctcccaagttctgtgttgcgtcaactggcgatctggtggctacttttcaaaccacctttctggtggactcaaccaccagatcgagcatcacctgtttcccagcatttctcacgccaactatcccaccattgctcctgttgtcaagggcgtgtgcgaggaatacggtcttccctacaagaactactctcagttttccgatgctctgtacggaatggtcgagcacttgcgagctatgggcaccaaacctgcagacaacgacaagcttgctcccactgcaggttccctggaggatgtttgtcctgtgctctctgctgccgttgctgcccaacccgacggctccaccgacggatctgctgccggttgtcctgctgtcgccactctggcttaagc

SEQ ID NO: 376 - DNA, 8576 bp, Artificial Sequence
  Plasmid pZuFmEaD4S-2
catggtccgacctgttggcaacccacctgcagcctattacgacgctctggccacctccggtactggacaggaccgaaagtttaccatgcgagaggtcgctcgacacattgttcccaccgatggctggttggcctgtcacgacggtgtgtacgacatcaccgagttcattggcaagcatcccggtggagatgttatctctctcggtctcggacgagactccactattctggtcgaatcgtaccatcctgcaggacgacccgacaaggttatggagaagtaccgaatcggtacacttcaggatcacagaaccttctacgactggcaggcctccgctttctacgccgagctcaagcagcgagtggttcagactctcaaggaggctggacaacctcgacgtggtggcctgtctgtcaaggcagcccttgttatggctgcctttgctgcctcgttctacctcatggtgacacagggatccttcttttgggctgccgtctggggtctggcaggctctcacattggactcagcatccagcacgacggcaatcatggtgctttctccaagtctggacgactcaaccgtcttgctggctggggtatggacgttatcggagcctcctcgactgcctgggagtaccaacacgtcattggtcatcaccagtacaccaacctggtgtccgatcccgagtttgctcttcccgagaacgatccagacgttttcggaacctatcccctcatgcggatgcatccggacactccttggaaaccccaccatcagctgcaacacgtgtacgcctttccgttgttcgctctcatgaccatcagcaaggtcattatctccgatttcacgttttgtcttgccaagcgacgtggtcccatcgacttctctgccagactcgttcccctcgagggtcagatgctgttctggggtgcaaagatcatgggctttctcatgcagattgtgcttccctgctacctgcatggcatcgctcacggattggccctcttcattacagctcatctggtttctggcgagtaccttgccgtctgtttcattatcaaccacatttccgagtcgtgcgactacctcaatccctcttccgttatcgctgcccgacggaccgaaatgctcaagcaggccgagcaggaagccaaggcgaaacagaagcaccccactccacctcccaacgactgggctgcctcccaagttctgtgttgcgtcaactggcgatctggtggctacttttcaaaccacctttctggtggactcaaccaccagatcgagcatcacctgtttcccagcatttctcacgccaactatcccaccattgctcctgttgtcaagggcgtgtgcgaggaatacggtcttccctacaagaactactctcagttttccgatgctctgtacggaatggtcgagcacttgcgagctatgggcaccaaacctgcagacaacgacaagcttgctcccactgcaggttccctggaggatgtttgtcctgtgctctctgctgccgttgctgcccaacccgacggctccaccgacggatctgctgccggttgtcctgctgtcgccactctggcttaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtac

SEQ ID NO: 377 - DNA, 8531 bp, Artificial Sequence
  Plasmid pZuFmEaD4S-3
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggccacctccggtactggacaggaccgaaagtttaccatgcgagaggtcgctcgacacattgttcccaccgatggctggttggcctgtcacgacggtgtgtacgacatcaccgagttcattggcaagcatcccggtggagatgttatctctctcggtctcggacgagactccactattctggtcgaatcgtaccatcctgcaggacgacccgacaaggttatggagaagtaccgaatcggtacacttcaggatcacagaaccttctacgactggcaggcctccgctttctacgccgagctcaagcagcgagtggttcagactctcaaggaggctggacaacctcgacgtggtggcctgtctgtcaaggcagcccttgttatggctgcctttgctgcctcgttctacctcatggtgacacagggatccttcttttgggctgccgtctggggtctggcaggctctcacattggactcagcatccagcacgacggcaatcatggtgctttctccaagtctggacgactcaaccgtcttgctggctggggtatggacgttatcggagcctcctcgactgcctgggagtaccaacacgtcattggtcatcaccagtacaccaacctggtgtccgatcccgagtttgctcttcccgagaacgatccagacgttttcggaacctatcccctcatgcggatgcatccggacactccttggaaaccccaccatcagctgcaacacgtgtacgcctttccgttgttcgctctcatgaccatcagcaaggtcattatctccgatttcacgttttgtcttgccaagcgacgtggtcccatcgacttctctgccagactcgttcccctcgagggtcagatgctgttctggggtgcaaagatcatgggctttctcatgcagattgtgcttccctgctacctgcatggcatcgctcacggattggccctcttcattacagctcatctggtttctggcgagtaccttgccgtctgtttcattatcaaccacatttccgagtcgtgcgactacctcaatccctcttccgttatcgctgcccgacggaccgaaatgctcaagcaggccgagcaggaagccaaggcgaaacagaagcaccccactccacctcccaacgactgggctgcctcccaagttctgtgttgcgtcaactggcgatctggtggctacttttcaaaccacctttctggtggactcaaccaccagatcgagcatcacctgtttcccagcatttctcacgccaactatcccaccattgctcctgttgtcaagggcgtgtgcgaggaatacggtcttccctacaagaactactctcagttttccgatgctctgtacggaatggtcgagcacttgcgagctatgggcaccaaacctgcagacaacgacaagcttgctcccactgcaggttccctggaggatgtttgtcctgtgctctctgctgccgttgctgcccaacccgacggctccaccgacggatctgctgccggttgtcctgctgtcgccactctggcttaagc

SEQ ID NO: 378 - DNA, 13304 bp, Artificial Sequence
  Plasmid pZKL4-220EA4-1
aaacagagtgtgaaagactcactatggtccgggcttatctcgaccaatagccaaagtctggagtttctgagagaaaaaggcaagatacgtatgtaacaaagcgacgcatggtacaataataccggaggcatgtatcatagagagttagtggttcgatgatggcactggtgcctggtatgactttatacggctgactacatatttgtcctcagacatacaattacagtcaagcacttacccttggacatctgtaggtaccccccggccaagacgatctcagcgtgtcgtatgtcggattggcgtagctccctcgctcgtcaattggctcccatctactttcttctgcttggctacacccagcatgtctgctatggctcgttttcgtgccttatctatcctcccagtattaccaactctaaatgacatgatgtgattgggtctacactttcatatcagagataaggagtagcacagttgcataaaaagcccaactctaatcagcttcttcctttcttgtaattagtacaaaggtgattagcgaaatctggaagcttagttggccctaaaaaaatcaaaaaaagcaaaaaacgaaaaacgaaaaaccacagttttgagaacagggaggtaacgaaggatcgtatatatatatatatatatatatacccacggatcccgagaccggcctttgattcttccctacaaccaaccattctcaccaccctaattcacaaccatggctgactctcccgtcatcaacctctccaccatgtggaagcctctgtcgctcatggccttggatcttgctgttctgggacacgtctggaagcaggcacaacaggagggctccatctcggcttacgccgactctgtgtggactcccctcatcatgtccggtctgtacctctccatgatcttcgtgggatgtcgatggatgaagaaccgagagcccttcgaaatcaagacctacatgtttgcctacaacctgtaccagaccctcatgaacctttgcattgtgctgggcttcctctaccaggtccacgctaccggtatgcgattctggggatctggcgtggaccgatcgcccaagggtctgggaattggctttttcatctatgcccattaccacaacaagtacgtcgagtacttcgacacactcttcatggtgctgcggaaaaagaacaaccagatttcctttcttcacgtctaccatcacgctctgctcacctgggcttggtttgccgtggtctacttcgctcctggaggtgacggctggtttggagcctgctacaattcctccattcatgtcctgatgtactcttactatctgcttgccaccttcggcatctcctgtccctggaaaaagatcctcacccagctgcaaatggttcagttctgcttttgcttcacccactcgatctacgtgtggatttgcggttccgaaatctaccctcgacccttgactgctctccagtccttcgtgatggtcaacatgctggttctctttggcaacttctacgtcaagcagtattctcagaagaatggaaagcccgagaacggtgccactcctgagaacggtgccaagcctcagccctgcgagaacggcaccgtcgagaagcgagagaacgacactgccaacgttcgataagcggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaactccgagccgtgagtatccacgacaagatcagtgtcgagacgacgcgttttgtgtaatgacacaatccgaaagtcgctagcaacacacactctctacacaaactaacccagctctggtaccatggccgagggcaagtccgacggtcccgtcgttaccctccagtccatgtggaagcccctggctctcatggccatcgacgtcggcatcctggtcaacgtgcgacggaaggccttcaccgagttcgacggacactcgaacgtcttcgccgatcccgtgtacattccctttgtcatgaacctgttctacctcaccatgatctttgctggctgccgatggatgaagactcgagaacccttcgagatcaagtcctacatgtttgcctacaacgcttaccagacaatgatgaactttctcattgtggtcggcttcatgtatgaggttcactccaccggtatgcgatactggggatccagaatcgacacttctaccaagggcttgggactgggtttcctcatctatgcccattaccacaacaagtacgtggagtacgtcgacaccctgttcatgattctgcggaagaaaaacaatcagatctcgttccttcacgtttaccaccattccctgctcacttgggcatggtgggctgtggtctactgggctcctggcggagatgcctggttcggtgcctgttacaactccttcatccacgttctcatgtactcctactatctgtttgccaccttcggcattcgatgtccctggaaaaagatgctcacccagttgcaaatggtccagttctgcttttgcttcgctcatgccatgtacgttggatggcttggtcacgaggtgtaccctcgatggctcactgctctgcaggcctttgtgatgctcaacatgctggtcctctttggcaacttctacatgaagtcttactccaaggcgagcaagctcgaaccagcctctcccgtgtcgcctgcctctcttgctcagaagcccttcgagaacgccaaggtcaagtaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgtagggatcaggtgcttaggaagctcgaccaaccacggagactgttgaaactggatgtcggtaacagcatctggaatgctgaatgttcctcgaataacaacatatttctccttgttgaggtgatcataagctatgtatccggtgattgaagtggaatagaagtctcctccgaagactgagtccaacgtcatgttcgggaaataccgacaactctctccacatgtaaaatcagttcgtagaggagtgactggcgcattgacacagtaggcgatgtttgcaatccgagaaaacttggccgtaaagttgtacagctcctgggaggcttgaactcgagtttttgaaagtgtcgctggtggctcgccgaagagggaggcatagaggtacgcaaccacttgcccgagcgtgaggttcatgatgccaatagtgaatgtcatttatcaccgtactgcgcagtatttatatagggctcatcggtccatgtatagatctgtccacttatgacacccccatgtctcattaatgtgtaaaggtggagacgggtggagtacaggtacagagttggaggaaatcaggatagtggggttaagacatgctccgagtccaaatttcaactctccattgtcacaagacctctggtttcagagttattacagatctaggcctgtttcaaggtgaggggacctcatctggatcggcacgacgatcgtcaccttacagaggacgtctgtcgcagggaaaggtgatgtggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgccaaggcgtatattagttggtgggaaccagtgtacgaccgggtcctgtataaccaggttcagtggcatacttgtaggagttgttcccgtggtatttgggcatggctaagacatttcgccgaccaatgttaagtgcacaatagccgatgtagtagatgtaagccagatggttttggagcaggtcgattcgagaccacagattgaaagtgcctcgatggcaggcctcgttttctcctccttcacagacagacactttgtcgagtgcagggtagacgctttcttggtcaatgtacacttctccaatggcgtgtgtgtaattggaccaatctggcagtccaacgaagatatcgttccagtgggtgagcctgtagtttcgtcgcttgtcgtttacttcaaggcctgtgtcattaaaccacagctggttgatgtagtttgcaaactctgagtttcctactctcggctggccaaagttgatcatggtaggatcatgtccaagtaatttgaagtgagttgcgaaaagaagagcttgagcagcgcccagcgagtgaccagtaacatacattttgtagtcagtgtggttggtgaggaacttttcaaactgaggagcagcattgaccatagtttcgttgaaggccttggcgaacccatcatggatcatgcagcctttgcactcactagttttgatgggaataagacgggggtcttcaaccaccagagcccgctctttgaggttgtcaagacctttgttctccacttccaagtctggtcggactgcccatctctgttaattaagttgcgacacatgtcttgatagtatcttgaattctctctcttgagcttttccataacaagttcttctgcctccaggaagtccatgggtggtttgatcatggttttggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgaccttttccttgggaaccaccaccgtcagcccttctgactcacgtattgtagccaccgacacaggcaacagtccgtggatagcagaatatgtcttgtcggtccatttctcaccaactttaggcgtcaagtgaatgttgcagaagaagtatgtgccttcattgagaatcggtgttgctgatttcaataaagtcttgagatcagtttggccagtcatgttgtggggggtaattggattgagttatcgcctacagtctgtacaggtatactcgctgcccactttatactttttgattccgctgcacttgaagcaatgtcgtttaccaaaagtgagaatgctccacagaacacaccccagggtatggttgagcaaaaaataaacactccgatacggggaatcgaaccccggtctccacggttctcaagaagtattcttgatgagagcgtatcgatcgaggaagaggacaagcggctgcttcttaagtttgtgacatcagtatccaaggcaccattgcaaggattcaaggctttgaacccgtcatttgccattcgtaacgctggtagacaggttgatcggttccctacggcctccacctgtgtcaatcttctcaagctgcctgactatcaggacattgatcaacttcggaagaaacttttgtatgccattcgatcacatgctggtttcgatttgtcttagaggaacgcatatacagtaatcatagagaataaacgatattcatttattaaagtagatagttgaggtagaagttgtaaagagtgataaatagcggccgcttaagccagagtggcgacagcaggacaaccggcagcagatccgtcggtggagccgtcgggttgggcagcaacggcagcagagagcacaggacaaacatcctccagggaacctgcagtgggagcaagcttgtcgttgtctgcaggtttggtgcccatagctcgcaagtgctcgaccattccgtacagagcatcggaaaactgagagtagttcttgtagggaagaccgtattcctcgcacacgcccttgacaacaggagcaatggtgggatagttggcgtgagaaatgctgggaaacaggtgatgctcgatctggtggttgagtccaccagaaaggtggtttgaaaagtagccaccagatcgccagttgacgcaacacagaacttgggaggcagcccagtcgttgggaggtggagtggggtgcttctgtttcgccttggcttcctgctcggcctgcttgagcatttcggtccgtcgggcagcgataacggaagagggattgaggtagtcgcacgactcggaaatgtggttgataatgaaacagacggcaaggtactcgccagaaaccagatgagctgtaatgaagagggccaatccgtgagcgatgccatgcaggtagcagggaagcacaatctgcatgagaaagcccatgatctttgcaccccagaacagcatctgaccctcgaggggaacgagtctggcagagaagtcgatgggaccacgtcgcttggcaagacaaaacgtgaaatcggagataatgaccttgctgatggtcatgagagcgaacaacggaaaggcgtacacgtgttgcagctgatggtggggtttccaaggagtgtccggatgcatccgcatgaggggataggttccgaaaacgtctggatcgttctcgggaagagcaaactcgggatcggacaccaggttggtgtactggtgatgaccaatgacgtgttggtactcccaggcagtcgaggaggctccgataacgtccataccccagccagcaagacggttgagtcgtccagacttggagaaagcaccatgattgccgtcgtgctggatgctgagtccaatgtgagagcctgccagaccccagacggcagcccaaaagaaggatccctgtgtcaccatgaggtagaacgaggcagcaaaggcagccataacaagggctgccttgacagacaggccaccacgtcgaggttgtccagcctccttgagagtctgaaccactcgctgcttgagctcggcgtagaaagcggaggcctgccagtcgtagaaggttctgtgatcctgaagtgtaccgattcggtacttctccataaccttgtcgggtcgtcctgcaggatggtacgattcgaccagaatagtggagtctcgtccgagaccgagagagataacatctccaccgggatgcttgccaatgaactcggtgatgtcgtacacaccgtcgtgacaggccaaccagccatcggtgggaacaatgtgtcgagcgacctctcgcatggtaaactttcggtcctgtccagtaccggaggtggccagagcgtcgtaataggctgcaggtgggttgccaacaggtcgaatgggaggtggaagagaagcgatctccgagggcttgccaggtccaccgggtttgaccttggccatggccattgctgtagatatgtcttgtgtgtaagggggttggggtggttgtttgtgttcttgacttttgtgttagcaagggaagacgggcaaaaaagtgagtgtggttgggagggagagacgagccttatatataatgcttgtttgtgtttgtgcaagtggacgccgaaacgggcaggagccaaactaaacaaggcagacaatgcgagcttaattggattgcctgatgggcaggggttagggctcgatcaatgggggtgcgaagtgacaaaattgggaattaggttcgcaagcaaggctgacaagactttggcccaaacatttgtacgcggtggacaacaggagccacccatcgtctgtcacgggctagccggtcgtgcgtcctgtcaggctccacctaggctccatgccactccatacaatcccactagtgtaccgctaggccgcttttagctcccatctaagacccccccaaaacctccactgtacagtgcactgtactgtgtggcgatcaagggcaagggaaaaaaggcgcaaacatgcacgcatggaatgacgtaggtaaggcgttactagactgaaaagtggcacatttcggcgtgccaaagggtcctaggtgcgtttcgcgagctgggcgccaggccaagccgctccaaaacgcctctccgactccctccagcggcctccatatccccatccctctccacagcaatgttgttaagccttgcaaacgaaaaaatagaaaggctaataagcttccaatattgtggtgtacgctgcataacgcaacaatgagcgccaaacaacacacacacacagcacacagcagcattaaccacgatgttt

SEQ ID NO: 379 - DNA, 13244 bp, Artificial Sequence
  Plasmid pZKL4-220EA4-2
catggccattgctgtagatatgtcttgtgtgtaagggggttggggtggttgtttgtgttcttgacttttgtgttagcaagggaagacgggcaaaaaagtgagtgtggttgggagggagagacgagccttatatataatgcttgtttgtgtttgtgcaagtggacgccgaaacgggcaggagccaaactaaacaaggcagacaatgcgagcttaattggattgcctgatgggcaggggttagggctcgatcaatgggggtgcgaagtgacaaaattgggaattaggttcgcaagcaaggctgacaagactttggcccaaacatttgtacgcggtggacaacaggagccacccatcgtctgtcacgggctagccggtcgtgcgtcctgtcaggctccacctaggctccatgccactccatacaatcccactagtgtaccgctaggccgcttttagctcccatctaagacccccccaaaacctccactgtacagtgcactgtactgtgtggcgatcaagggcaagggaaaaaaggcgcaaacatgcacgcatggaatgacgtaggtaaggcgttactagactgaaaagtggcacatttcggcgtgccaaagggtcctaggtgcgtttcgcgagctgggcgccaggccaagccgctccaaaacgcctctccgactccctccagcggcctccatatccccatccctctccacagcaatgttgttaagccttgcaaacgaaaaaatagaaaggctaataagcttccaatattgtggtgtacgctgcataacgcaacaatgagcgccaaacaacacacacacacagcacacagcagcattaaccacgatgtttaaacagagtgtgaaagactcactatggtccgggcttatctcgaccaatagccaaagtctggagtttctgagagaaaaaggcaagatacgtatgtaacaaagcgacgcatggtacaataataccggaggcatgtatcatagagagttagtggttcgatgatggcactggtgcctggtatgactttatacggctgactacatatttgtcctcagacatacaattacagtcaagcacttacccttggacatctgtaggtaccccccggccaagacgatctcagcgtgtcgtatgtcggattggcgtagctccctcgctcgtcaattggctcccatctactttcttctgcttggctacacccagcatgtctgctatggctcgttttcgtgccttatctatcctcccagtattaccaactctaaatgacatgatgtgattgggtctacactttcatatcagagataaggagtagcacagttgcataaaaagcccaactctaatcagcttcttcctttcttgtaattagtacaaaggtgattagcgaaatctggaagcttagttggccctaaaaaaatcaaaaaaagcaaaaaacgaaaaacgaaaaaccacagttttgagaacagggaggtaacgaaggatcgtatatatatatatatatatatatacccacggatcccgagaccggcctttgattcttccctacaaccaaccattctcaccaccctaattcacaaccatggctgactctcccgtcatcaacctctccaccatgtggaagcctctgtcgctcatggccttggatcttgctgttctgggacacgtctggaagcaggcacaacaggagggctccatctcggcttacgccgactctgtgtggactcccctcatcatgtccggtctgtacctctccatgatcttcgtgggatgtcgatggatgaagaaccgagagcccttcgaaatcaagacctacatgtttgcctacaacctgtaccagaccctcatgaacctttgcattgtgctgggcttcctctaccaggtccacgctaccggtatgcgattctggggatctggcgtggaccgatcgcccaagggtctgggaattggctttttcatctatgcccattaccacaacaagtacgtcgagtacttcgacacactcttcatggtgctgcggaaaaagaacaaccagatttcctttcttcacgtctaccatcacgctctgctcacctgggcttggtttgccgtggtctacttcgctcctggaggtgacggctggtttggagcctgctacaattcctccattcatgtcctgatgtactcttactatctgcttgccaccttcggcatctcctgtccctggaaaaagatcctcacccagctgcaaatggttcagttctgcttttgcttcacccactcgatctacgtgtggatttgcggttccgaaatctaccctcgacccttgactgctctccagtccttcgtgatggtcaacatgctggttctctttggcaacttctacgtcaagcagtattctcagaagaatggaaagcccgagaacggtgccactcctgagaacggtgccaagcctcagccctgcgagaacggcaccgtcgagaagcgagagaacgacactgccaacgttcgataagcggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaactccgagccgtgagtatccacgacaagatcagtgtcgagacgacgcgttttgtgtaatgacacaatccgaaagtcgctagcaacacacactctctacacaaactaacccagctctggtaccatggccgagggcaagtccgacggtcccgtcgttaccctccagtccatgtggaagcccctggctctcatggccatcgacgtcggcatcctggtcaacgtgcgacggaaggccttcaccgagttcgacggacactcgaacgtcttcgccgatcccgtgtacattccctttgtcatgaacctgttctacctcaccatgatctttgctggctgccgatggatgaagactcgagaacccttcgagatcaagtcctacatgtttgcctacaacgcttaccagacaatgatgaactttctcattgtggtcggcttcatgtatgaggttcactccaccggtatgcgatactggggatccagaatcgacacttctaccaagggcttgggactgggtttcctcatctatgcccattaccacaacaagtacgtggagtacgtcgacaccctgttcatgattctgcggaagaaaaacaatcagatctcgttccttcacgtttaccaccattccctgctcacttgggcatggtgggctgtggtctactgggctcctggcggagatgcctggttcggtgcctgttacaactccttcatccacgttctcatgtactcctactatctgtttgccaccttcggcattcgatgtccctggaaaaagatgctcacccagttgcaaatggtccagttctgcttttgcttcgctcatgccatgtacgttggatggcttggtcacgaggtgtaccctcgatggctcactgctctgcaggcctttgtgatgctcaacatgctggtcctctttggcaacttctacatgaagtcttactccaaggcgagcaagctcgaaccagcctctcccgtgtcgcctgcctctcttgctcagaagcccttcgagaacgccaaggtcaagtaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgtagggatcaggtgcttaggaagctcgaccaaccacggagactgttgaaactggatgtcggtaacagcatctggaatgctgaatgttcctcgaataacaacatatttctccttgttgaggtgatcataagctatgtatccggtgattgaagtggaatagaagtctcctccgaagactgagtccaacgtcatgttcgggaaataccgacaactctctccacatgtaaaatcagttcgtagaggagtgactggcgcattgacacagtaggcgatgtttgcaatccgagaaaacttggccgtaaagttgtacagctcctgggaggcttgaactcgagtttttgaaagtgtcgctggtggctcgccgaagagggaggcatagaggtacgcaaccacttgcccgagcgtgaggttcatgatgccaatagtgaatgtcatttatcaccgtactgcgcagtatttatatagggctcatcggtccatgtatagatctgtccacttatgacacccccatgtctcattaatgtgtaaaggtggagacgggtggagtacaggtacagagttggaggaaatcaggatagtggggttaagacatgctccgagtccaaatttcaactctccattgtcacaagacctctggtttcagagttattacagatctaggcctgtttcaaggtgaggggacctcatctggatcggcacgacgatcgtcaccttacagaggacgtctgtcgcagggaaaggtgatgtggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgccaaggcgtatattagttggtgggaaccagtgtacgaccgggtcctgtataaccaggttcagtggcatacttgtaggagttgttcccgtggtatttgggcatggctaagacatttcgccgaccaatgttaagtgcacaatagccgatgtagtagatgtaagccagatggttttggagcaggtcgattcgagaccacagattgaaagtgcctcgatggcaggcctcgttttctcctccttcacagacagacactttgtcgagtgcagggtagacgctttcttggtcaatgtacacttctccaatggcgtgtgtgtaattggaccaatctggcagtccaacgaagatatcgttccagtgggtgagcctgtagtttcgtcgcttgtcgtttacttcaaggcctgtgtcattaaaccacagctggttgatgtagtttgcaaactctgagtttcctactctcggctggccaaagttgatcatggtaggatcatgtccaagtaatttgaagtgagttgcgaaaagaagagcttgagcagcgcccagcgagtgaccagtaacatacattttgtagtcagtgtggttggtgaggaacttttcaaactgaggagcagcattgaccatagtttcgttgaaggccttggcgaacccatcatggatcatgcagcctttgcactcactagttttgatgggaataagacgggggtcttcaaccaccagagcccgctctttgaggttgtcaagacctttgttctccacttccaagtctggtcggactgcccatctctgttaattaagttgcgacacatgtcttgatagtatcttgaattctctctcttgagcttttccataacaagttcttctgcctccaggaagtccatgggtggtttgatcatggttttggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgaccttttccttgggaaccaccaccgtcagcccttctgactcacgtattgtagccaccgacacaggcaacagtccgtggatagcagaatatgtcttgtcggtccatttctcaccaactttaggcgtcaagtgaatgttgcagaagaagtatgtgccttcattgagaatcggtgttgctgatttcaataaagtcttgagatcagtttggccagtcatgttgtggggggtaattggattgagttatcgcctacagtctgtacaggtatactcgctgcccactttatactttttgattccgctgcacttgaagcaatgtcgtttaccaaaagtgagaatgctccacagaacacaccccagggtatggttgagcaaaaaataaacactccgatacggggaatcgaaccccggtctccacggttctcaagaagtattcttgatgagagcgtatcgatcgaggaagaggacaagcggctgcttcttaagtttgtgacatcagtatccaaggcaccattgcaaggattcaaggctttgaacccgtcatttgccattcgtaacgctggtagacaggttgatcggttccctacggcctccacctgtgtcaatcttctcaagctgcctgactatcaggacattgatcaacttcggaagaaacttttgtatgccattcgatcacatgctggtttcgatttgtcttagaggaacgcatatacagtaatcatagagaataaacgatattcatttattaaagtagatagttgaggtagaagttgtaaagagtgataaatagcggccgcttaagccagagtggcgacagcaggacaaccggcagcagatccgtcggtggagccgtcgggttgggcagcaacggcagcagagagcacaggacaaacatcctccagggaacctgcagtgggagcaagcttgtcgttgtctgcaggtttggtgcccatagctcgcaagtgctcgaccattccgtacagagcatcggaaaactgagagtagttcttgtagggaagaccgtattcctcgcacacgcccttgacaacaggagcaatggtgggatagttggcgtgagaaatgctgggaaacaggtgatgctcgatctggtggttgagtccaccagaaaggtggtttgaaaagtagccaccagatcgccagttgacgcaacacagaacttgggaggcagcccagtcgttgggaggtggagtggggtgcttctgtttcgccttggcttcctgctcggcctgcttgagcatttcggtccgtcgggcagcgataacggaagagggattgaggtagtcgcacgactcggaaatgtggttgataatgaaacagacggcaaggtactcgccagaaaccagatgagctgtaatgaagagggccaatccgtgagcgatgccatgcaggtagcagggaagcacaatctgcatgagaaagcccatgatctttgcaccccagaacagcatctgaccctcgaggggaacgagtctggcagagaagtcgatgggaccacgtcgcttggcaagacaaaacgtgaaatcggagataatgaccttgctgatggtcatgagagcgaacaacggaaaggcgtacacgtgttgcagctgatggtggggtttccaaggagtgtccggatgcatccgcatgaggggataggttccgaaaacgtctggatcgttctcgggaagagcaaactcgggatcggacaccaggttggtgtactggtgatgaccaatgacgtgttggtactcccaggcagtcgaggaggctccgataacgtccataccccagccagcaagacggttgagtcgtccagacttggagaaagcaccatgattgccgtcgtgctggatgctgagtccaatgtgagagcctgccagaccccagacggcagcccaaaagaaggatccctgtgtcaccatgaggtagaacgaggcagcaaaggcagccataacaagggctgccttgacagacaggccaccacgtcgaggttgtccagcctccttgagagtctgaaccactcgctgcttgagctcggcgtagaaagcggaggcctgccagtcgtagaaggttctgtgatcctgaagtgtaccgattcggtacttctccataaccttgtcgggtcgtcctgcaggatggtacgattcgaccagaatagtggagtctcgtccgagaccgagagagataacatctccaccgggatgcttgccaatgaactcggtgatgtcgtacacaccgtcgtgacaggccaaccagccatcggtgggaacaatgtgtcgagcgacctctcgcatggtaaactttcggtcctgtccagtaccggaggtggccagagcgtcgtaataggctgcaggtgggttgccaacaggtcggac

SEQ ID NO: 380 - DNA, 13199 bp, Artificial Sequence
  Plasmid pZKL4-220EA4-3
catggccattgctgtagatatgtcttgtgtgtaagggggttggggtggttgtttgtgttcttgacttttgtgttagcaagggaagacgggcaaaaaagtgagtgtggttgggagggagagacgagccttatatataatgcttgtttgtgtttgtgcaagtggacgccgaaacgggcaggagccaaactaaacaaggcagacaatgcgagcttaattggattgcctgatgggcaggggttagggctcgatcaatgggggtgcgaagtgacaaaattgggaattaggttcgcaagcaaggctgacaagactttggcccaaacatttgtacgcggtggacaacaggagccacccatcgtctgtcacgggctagccggtcgtgcgtcctgtcaggctccacctaggctccatgccactccatacaatcccactagtgtaccgctaggccgcttttagctcccatctaagacccccccaaaacctccactgtacagtgcactgtactgtgtggcgatcaagggcaagggaaaaaaggcgcaaacatgcacgcatggaatgacgtaggtaaggcgttactagactgaaaagtggcacatttcggcgtgccaaagggtcctaggtgcgtttcgcgagctgggcgccaggccaagccgctccaaaacgcctctccgactccctccagcggcctccatatccccatccctctccacagcaatgttgttaagccttgcaaacgaaaaaatagaaaggctaataagcttccaatattgtggtgtacgctgcataacgcaacaatgagcgccaaacaacacacacacacagcacacagcagcattaaccacgatgtttaaacagagtgtgaaagactcactatggtccgggcttatctcgaccaatagccaaagtctggagtttctgagagaaaaaggcaagatacgtatgtaacaaagcgacgcatggtacaataataccggaggcatgtatcatagagagttagtggttcgatgatggcactggtgcctggtatgactttatacggctgactacatatttgtcctcagacatacaattacagtcaagcacttacccttggacatctgtaggtaccccccggccaagacgatctcagcgtgtcgtatgtcggattggcgtagctccctcgctcgtcaattggctcccatctactttcttctgcttggctacacccagcatgtctgctatggctcgttttcgtgccttatctatcctcccagtattaccaactctaaatgacatgatgtgattgggtctacactttcatatcagagataaggagtagcacagttgcataaaaagcccaactctaatcagcttcttcctttcttgtaattagtacaaaggtgattagcgaaatctggaagcttagttggccctaaaaaaatcaaaaaaagcaaaaaacgaaaaacgaaaaaccacagttttgagaacagggaggtaacgaaggatcgtatatatatatatatatatatatacccacggatcccgagaccggcctttgattcttccctacaaccaaccattctcaccaccctaattcacaaccatggctgactctcccgtcatcaacctctccaccatgtggaagcctctgtcgctcatggccttggatcttgctgttctgggacacgtctggaagcaggcacaacaggagggctccatctcggcttacgccgactctgtgtggactcccctcatcatgtccggtctgtacctctccatgatcttcgtgggatgtcgatggatgaagaaccgagagcccttcgaaatcaagacctacatgtttgcctacaacctgtaccagaccctcatgaacctttgcattgtgctgggcttcctctaccaggtccacgctaccggtatgcgattctggggatctggcgtggaccgatcgcccaagggtctgggaattggctttttcatctatgcccattaccacaacaagtacgtcgagtacttcgacacactcttcatggtgctgcggaaaaagaacaaccagatttcctttcttcacgtctaccatcacgctctgctcacctgggcttggtttgccgtggtctacttcgctcctggaggtgacggctggtttggagcctgctacaattcctccattcatgtcctgatgtactcttactatctgcttgccaccttcggcatctcctgtccctggaaaaagatcctcacccagctgcaaatggttcagttctgcttttgcttcacccactcgatctacgtgtggatttgcggttccgaaatctaccctcgacccttgactgctctccagtccttcgtgatggtcaacatgctggttctctttggcaacttctacgtcaagcagtattctcagaagaatggaaagcccgagaacggtgccactcctgagaacggtgccaagcctcagccctgcgagaacggcaccgtcgagaagcgagagaacgacactgccaacgttcgataagcggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaactccgagccgtgagtatccacgacaagatcagtgtcgagacgacgcgttttgtgtaatgacacaatccgaaagtcgctagcaacacacactctctacacaaactaacccagctctggtaccatggccgagggcaagtccgacggtcccgtcgttaccctccagtccatgtggaagcccctggctctcatggccatcgacgtcggcatcctggtcaacgtgcgacggaaggccttcaccgagttcgacggacactcgaacgtcttcgccgatcccgtgtacattccctttgtcatgaacctgttctacctcaccatgatctttgctggctgccgatggatgaagactcgagaacccttcgagatcaagtcctacatgtttgcctacaacgcttaccagacaatgatgaactttctcattgtggtcggcttcatgtatgaggttcactccaccggtatgcgatactggggatccagaatcgacacttctaccaagggcttgggactgggtttcctcatctatgcccattaccacaacaagtacgtggagtacgtcgacaccctgttcatgattctgcggaagaaaaacaatcagatctcgttccttcacgtttaccaccattccctgctcacttgggcatggtgggctgtggtctactgggctcctggcggagatgcctggttcggtgcctgttacaactccttcatccacgttctcatgtactcctactatctgtttgccaccttcggcattcgatgtccctggaaaaagatgctcacccagttgcaaatggtccagttctgcttttgcttcgctcatgccatgtacgttggatggcttggtcacgaggtgtaccctcgatggctcactgctctgcaggcctttgtgatgctcaacatgctggtcctctttggcaacttctacatgaagtcttactccaaggcgagcaagctcgaaccagcctctcccgtgtcgcctgcctctcttgctcagaagcccttcgagaacgccaaggtcaagtaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgtagggatcaggtgcttaggaagctcgaccaaccacggagactgttgaaactggatgtcggtaacagcatctggaatgctgaatgttcctcgaataacaacatatttctccttgttgaggtgatcataagctatgtatccggtgattgaagtggaatagaagtctcctccgaagactgagtccaacgtcatgttcgggaaataccgacaactctctccacatgtaaaatcagttcgtagaggagtgactggcgcattgacacagtaggcgatgtttgcaatccgagaaaacttggccgtaaagttgtacagctcctgggaggcttgaactcgagtttttgaaagtgtcgctggtggctcgccgaagagggaggcatagaggtacgcaaccacttgcccgagcgtgaggttcatgatgccaatagtgaatgtcatttatcaccgtactgcgcagtatttatatagggctcatcggtccatgtatagatctgtccacttatgacacccccatgtctcattaatgtgtaaaggtggagacgggtggagtacaggtacagagttggaggaaatcaggatagtggggttaagacatgctccgagtccaaatttcaactctccattgtcacaagacctctggtttcagagttattacagatctaggcctgtttcaaggtgaggggacctcatctggatcggcacgacgatcgtcaccttacagaggacgtctgtcgcagggaaaggtgatgtggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgccaaggcgtatattagttggtgggaaccagtgtacgaccgggtcctgtataaccaggttcagtggcatacttgtaggagttgttcccgtggtatttgggcatggctaagacatttcgccgaccaatgttaagtgcacaatagccgatgtagtagatgtaagccagatggttttggagcaggtcgattcgagaccacagattgaaagtgcctcgatggcaggcctcgttttctcctccttcacagacagacactttgtcgagtgcagggtagacgctttcttggtcaatgtacacttctccaatggcgtgtgtgtaattggaccaatctggcagtccaacgaagatatcgttccagtgggtgagcctgtagtttcgtcgcttgtcgtttacttcaaggcctgtgtcattaaaccacagctggttgatgtagtttgcaaactctgagtttcctactctcggctggccaaagttgatcatggtaggatcatgtccaagtaatttgaagtgagttgcgaaaagaagagcttgagcagcgcccagcgagtgaccagtaacatacattttgtagtcagtgtggttggtgaggaacttttcaaactgaggagcagcattgaccatagtttcgttgaaggccttggcgaacccatcatggatcatgcagcctttgcactcactagttttgatgggaataagacgggggtcttcaaccaccagagcccgctctttgaggttgtcaagacctttgttctccacttccaagtctggtcggactgcccatctctgttaattaagttgcgacacatgtcttgatagtatcttgaattctctctcttgagcttttccataacaagttcttctgcctccaggaagtccatgggtggtttgatcatggttttggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgaccttttccttgggaaccaccaccgtcagcccttctgactcacgtattgtagccaccgacacaggcaacagtccgtggatagcagaatatgtcttgtcggtccatttctcaccaactttaggcgtcaagtgaatgttgcagaagaagtatgtgccttcattgagaatcggtgttgctgatttcaataaagtcttgagatcagtttggccagtcatgttgtggggggtaattggattgagttatcgcctacagtctgtacaggtatactcgctgcccactttatactttttgattccgctgcacttgaagcaatgtcgtttaccaaaagtgagaatgctccacagaacacaccccagggtatggttgagcaaaaaataaacactccgatacggggaatcgaaccccggtctccacggttctcaagaagtattcttgatgagagcgtatcgatcgaggaagaggacaagcggctgcttcttaagtttgtgacatcagtatccaaggcaccattgcaaggattcaaggctttgaacccgtcatttgccattcgtaacgctggtagacaggttgatcggttccctacggcctccacctgtgtcaatcttctcaagctgcctgactatcaggacattgatcaacttcggaagaaacttttgtatgccattcgatcacatgctggtttcgatttgtcttagaggaacgcatatacagtaatcatagagaataaacgatattcatttattaaagtagatagttgaggtagaagttgtaaagagtgataaatagcggccgcttaagccagagtggcgacagcaggacaaccggcagcagatccgtcggtggagccgtcgggttgggcagcaacggcagcagagagcacaggacaaacatcctccagggaacctgcagtgggagcaagcttgtcgttgtctgcaggtttggtgcccatagctcgcaagtgctcgaccattccgtacagagcatcggaaaactgagagtagttcttgtagggaagaccgtattcctcgcacacgcccttgacaacaggagcaatggtgggatagttggcgtgagaaatgctgggaaacaggtgatgctcgatctggtggttgagtccaccagaaaggtggtttgaaaagtagccaccagatcgccagttgacgcaacacagaacttgggaggcagcccagtcgttgggaggtggagtggggtgcttctgtttcgccttggcttcctgctcggcctgcttgagcatttcggtccgtcgggcagcgataacggaagagggattgaggtagtcgcacgactcggaaatgtggttgataatgaaacagacggcaaggtactcgccagaaaccagatgagctgtaatgaagagggccaatccgtgagcgatgccatgcaggtagcagggaagcacaatctgcatgagaaagcccatgatctttgcaccccagaacagcatctgaccctcgaggggaacgagtctggcagagaagtcgatgggaccacgtcgcttggcaagacaaaacgtgaaatcggagataatgaccttgctgatggtcatgagagcgaacaacggaaaggcgtacacgtgttgcagctgatggtggggtttccaaggagtgtccggatgcatccgcatgaggggataggttccgaaaacgtctggatcgttctcgggaagagcaaactcgggatcggacaccaggttggtgtactggtgatgaccaatgacgtgttggtactcccaggcagtcgaggaggctccgataacgtccataccccagccagcaagacggttgagtcgtccagacttggagaaagcaccatgattgccgtcgtgctggatgctgagtccaatgtgagagcctgccagaccccagacggcagcccaaaagaaggatccctgtgtcaccatgaggtagaacgaggcagcaaaggcagccataacaagggctgccttgacagacaggccaccacgtcgaggttgtccagcctccttgagagtctgaaccactcgctgcttgagctcggcgtagaaagcggaggcctgccagtcgtagaaggttctgtgatcctgaagtgtaccgattcggtacttctccataaccttgtcgggtcgtcctgcaggatggtacgattcgaccagaatagtggagtctcgtccgagaccgagagagataacatctccaccgggatgcttgccaatgaactcggtgatgtcgtacacaccgtcgtgacaggccaaccagccatcggtgggaacaatgtgtcgagcgacctctcgcatggtaaactttcggtcctgtccagtaccggaggtggc

SEQ ID NO: 381 - DNA, 1644 bp, Euglena anabaena
  CDS (1)..(1644): synthetic truncated delta-4 desaturase (codon-optimized for Yarrowia lipolytica)
atggccaaggtcaaacccggtggacctggcaagccctcggagatcgcttctcttccacctcccattcgacctgttggcaacccacctgcagcctattacgacgctctggccacctccggtactggacaggaccgaaagtttaccatgcgagaggtcgctcgacacattgttcccaccgatggctggttggcctgtcacgacggtgtgtacgacatcaccgagttcattggcaagcatcccggtggagatgttatctctctcggtctcggacgagactccactattctggtcgaatcgtaccatcctgcaggacgacccgacaaggttatggagaagtaccgaatcggtacacttcaggatcacagaaccttctacgactggcaggcctccgctttctacgccgagctcaagcagcgagtggttcagactctcaaggaggctggacaacctcgacgtggtggcctgtctgtcaaggcagcccttgttatggctgcctttgctgcctcgttctacctcatggtgacacagggatccttcttttgggctgccgtctggggtctggcaggctctcacattggactcagcatccagcacgacggcaatcatggtgctttctccaagtctggacgactcaaccgtcttgctggctggggtatggacgttatcggagcctcctcgactgcctgggagtaccaacacgtcattggtcatcaccagtacaccaacctggtgtccgatcccgagtttgctcttcccgagaacgatccagacgttttcggaacctatcccctcatgcggatgcatccggacactccttggaaaccccaccatcagctgcaacacgtgtacgcctttccgttgttcgctctcatgaccatcagcaaggtcattatctccgatttcacgttttgtcttgccaagcgacgtggtcccatcgacttctctgccagactcgttcccctcgagggtcagatgctgttctggggtgcaaagatcatgggctttctcatgcagattgtgcttccctgctacctgcatggcatcgctcacggattggccctcttcattacagctcatctggtttctggcgagtaccttgccgtctgtttcattatcaaccacatttccgagtcgtgcgactacctcaatccctcttccgttatcgctgcccgacggaccgaaatgctcaagcaggccgagcaggaagccaaggcgaaacagaagcaccccactccacctcccaacgactgggctgcctcccaagttctgtgttgcgtcaactggcgatctggtggctacttttcaaaccacctttctggtggactcaaccaccagatcgagcatcacctgtttcccagcatttctcacgccaactatcccaccattgctcctgttgtcaagggcgtgtgcgaggaatacggtcttccctacaagaactactctcagttttccgatgctctgtacggaatggtcgagcacttgcgagctatgggcaccaaacctgcagacaacgacaagcttgctcccactgcaggttccctggaggatgtttgtcctgtgctctctgctgccgttgctgcccaacccgacggctccaccgacggatctgctgccggttgtcctgctgtcgccactctggcttaa

SEQ ID NO: 382 - protein, 547 aa, Euglena anabaena
MAKVKPGGPGKPSEIASLPPPIRPVGNPPAAYYDALATSGTGQDRKFTMREVARHIVPTDGWLACHDGVYDITEFIGKHPGGDVISLGLGRDSTILVESYHPAGRPDKVMEKYRIGTLQDHRTFYDWQASAFYAELKQRVVQTLKEAGQPRRGGLSVKAALVMAAFAASFYLMVTQGSFFWAAVWGLAGSHIGLSIQHDGNHGAFSKSGRLNRLAGWGMDVIGASSTAWEYQHVIGHHQYTNLVSDPEFALPENDPDVFGTYPLMRMHPDTPWKPHHQLQHVYAFPLFALMTISKVIISDFTFCLAKRRGPIDFSARLVPLEGQMLFWGAKIMGFLMQIVLPCYLHGIAHGLALFITAHLVSGEYLAVCFIINHISESCDYLNPSSVIAARRTEMLKQAEQEAKAKQKHPTPPPNDWAASQVLCCVNWRSGGYFSNHLSGGLNHQIEHHLFPSISHANYPTIAPVVKGVCEEYGLPYKNYSQFSDALYGMVEHLRAMGTKPADNDKLAPTAGSLEDVCPVLSAAVAAQPDGSTDGSAAGCPAVATLA

SEQ ID NO: 383 - DNA, 1584 bp, Euglena anabaena
  CDS (1)..(1584): synthetic truncated delta-4 desaturase (codon-optimized for Yarrowia lipolytica)
atggtccgacctgttggcaacccacctgcagcctattacgacgctctggccacctccggtactggacaggaccgaaagtttaccatgcgagaggtcgctcgacacattgttcccaccgatggctggttggcctgtcacgacggtgtgtacgacatcaccgagttcattggcaagcatcccggtggagatgttatctctctcggtctcggacgagactccactattctggtcgaatcgtaccatcctgcaggacgacccgacaaggttatggagaagtaccgaatcggtacacttcaggatcacagaaccttctacgactggcaggcctccgctttctacgccgagctcaagcagcgagtggttcagactctcaaggaggctggacaacctcgacgtggtggcctgtctgtcaaggcagcccttgttatggctgcctttgctgcctcgttctacctcatggtgacacagggatccttcttttgggctgccgtctggggtctggcaggctctcacattggactcagcatccagcacgacggcaatcatggtgctttctccaagtctggacgactcaaccgtcttgctggctggggtatggacgttatcggagcctcctcgactgcctgggagtaccaacacgtcattggtcatcaccagtacaccaacctggtgtccgatcccgagtttgctcttcccgagaacgatccagacgttttcggaacctatcccctcatgcggatgcatccggacactccttggaaaccccaccatcagctgcaacacgtgtacgcctttccgttgttcgctctcatgaccatcagcaaggtcattatctccgatttcacgttttgtcttgccaagcgacgtggtcccatcgacttctctgccagactcgttcccctcgagggtcagatgctgttctggggtgcaaagatcatgggctttctcatgcagattgtgcttccctgctacctgcatggcatcgctcacggattggccctcttcattacagctcatctggtttctggcgagtaccttgccgtctgtttcattatcaaccacatttccgagtcgtgcgactacctcaatccctcttccgttatcgctgcccgacggaccgaaatgctcaagcaggccgagcaggaagccaaggcgaaacagaagcaccccactccacctcccaacgactgggctgcctcccaagttctgtgttgcgtcaactggcgatctggtggctacttttcaaaccacctttctggtggactcaaccaccagatcgagcatcacctgtttcccagcatttctcacgccaactatcccaccattgctcctgttgtcaagggcgtgtgcgaggaatacggtcttccctacaagaactactctcagttttccgatgctctgtacggaatggtcgagcacttgcgagctatgggcaccaaacctgcagacaacgacaagcttgctcccactgcaggttccctggaggatgtttgtcctgtgctctctgctgccgttgctgcccaacccgacggctccaccgacggatctgctgccggttgtcctgctgtcgccactctggcttaa

SEQ ID NO: 384 - protein, 527 aa, Euglena anabaena
MVRPVGNPPAAYYDALATSGTGQDRKFTMREVARHIVPTDGWLACHDGVYDITEFIGKHPGGDVISLGLGRDSTILVESYHPAGRPDKVMEKYRIGTLQDHRTFYDWQASAFYAELKQRVVQTLKEAGQPRRGGLSVKAALVMAAFAASFYLMVTQGSFFWAAVWGLAGSHIGLSIQHDGNHGAFSKSGRLNRLAGWGMDVIGASSTAWEYQHVIGHHQYTNLVSDPEFALPENDPDVFGTYPLMRMHPDTPWKPHHQLQHVYAFPLFALMTISKVIISDFTFCLAKRRGPIDFSARLVPLEGQMLFWGAKIMGFLMQIVLPCYLHGIAHGLALFITAHLVSGEYLAVCFIINHISESCDYLNPSSVIAARRTEMLKQAEQEAKAKQKHPTPPPNDWAASQVLCCVNWRSGGYFSNHLSGGLNHQIEHHLFPSISHANYPTIAPVVKGVCEEYGLPYKNYSQFSDALYGMVEHLRAMGTKPADNDKLAPTAGSLEDVCPVLSAAVAAQPDGSTDGSAAGCPAVATLA

SEQ ID NO: 385 - DNA, 1539 bp, Euglena anabaena
  CDS (1)..(1539): synthetic truncated delta-4 desaturase (codon-optimized for Yarrowia lipolytica)
atggccacctccggtactggacaggaccgaaagtttaccatgcgagaggtcgctcgacacattgttcccaccgatggctggttggcctgtcacgacggtgtgtacgacatcaccgagttcattggcaagcatcccggtggagatgttatctctctcggtctcggacgagactccactattctggtcgaatcgtaccatcctgcaggacgacccgacaaggttatggagaagtaccgaatcggtacacttcaggatcacagaaccttctacgactggcaggcctccgctttctacgccgagctcaagcagcgagtggttcagactctcaaggaggctggacaacctcgacgtggtggcctgtctgtcaaggcagcccttgttatggctgcctttgctgcctcgttctacctcatggtgacacagggatccttcttttgggctgccgtctggggtctggcaggctctcacattggactcagcatccagcacgacggcaatcatggtgctttctccaagtctggacgactcaaccgtcttgctggctggggtatggacgttatcggagcctcctcgactgcctgggagtaccaacacgtcattggtcatcaccagtacaccaacctggtgtccgatcccgagtttgctcttcccgagaacgatccagacgttttcggaacctatcccctcatgcggatgcatccggacactccttggaaaccccaccatcagctgcaacacgtgtacgcctttccgttgttcgctctcatgaccatcagcaaggtcattatctccgatttcacgttttgtcttgccaagcgacgtggtcccatcgacttctctgccagactcgttcccctcgagggtcagatgctgttctggggtgcaaagatcatgggctttctcatgcagattgtgcttccctgctacctgcatggcatcgctcacggattggccctcttcattacagctcatctggtttctggcgagtaccttgccgtctgtttcattatcaaccacatttccgagtcgtgcgactacctcaatccctcttccgttatcgctgcccgacggaccgaaatgctcaagcaggccgagcaggaagccaaggcgaaacagaagcaccccactccacctcccaacgactgggctgcctcccaagttctgtgttgcgtcaactggcgatctggtggctacttttcaaaccacctttctggtggactcaaccaccagatcgagcatcacctgtttcccagcatttctcacgccaactatcccaccattgctcctgttgtcaagggcgtgtgcgaggaatacggtcttccctacaagaactactctcagttttccgatgctctgtacggaatggtcgagcacttgcgagctatgggcaccaaacctgcagacaacgacaagcttgctcccactgcaggttccctggaggatgtttgtcctgtgctctctgctgccgttgctgcccaacccgacggctccaccgacggatctgctgccggttgtcctgctgtcgccactctggcttaa

SEQ ID NO: 386 - protein, 512 aa, Euglena anabaena
MATSGTGQDRKFTMREVARHIVPTDGWLACHDGVYDITEFIGKHPGGDVISLGLGRDSTILVESYHPAGRPDKVMEKYRIGTLQDHRTFYDWQASAFYAELKQRVVQTLKEAGQPRRGGLSVKAALVMAAFAASFYLMVTQGSFFWAAVWGLAGSHIGLSIQHDGNHGAFSKSGRLNRLAGWGMDVIGASSTAWEYQHVIGHHQYTNLVSDPEFALPENDPDVFGTYPLMRMHPDTPWKPHHQLQHVYAFPLFALMTISKVIISDFTFCLAKRRGPIDFSARLVPLEGQMLFWGAKIMGFLMQIVLPCYLHGIAHGLALFITAHLVSGEYLAVCFIINHISESCDYLNPSSVIAARRTEMLKQAEQEAKAKQKHPTPPPNDWAASQVLCCVNWRSGGYFSNHLSGGLNHQIEHHLFPSISHANYPTIAPVVKGVCEEYGLPYKNYSQFSDALYGMVEHLRAMGTKPADNDKLAPTAGSLEDVCPVLSAAVAAQPDGSTDGSAAGCPAVATLA

SEQ ID NO: 387 - DNA, 1623 bp, Euglena gracilis
  CDS (1)..(1623): synthetic delta-4 desaturase (codon-optimized for Yarrowia lipolytica)
atggtcctgttcggcaacttctacgtcaagcagtactcccagaagaacggaaagcccgagaacggtgccactcccgagaacggagccaaaccgcaaccttgcgagaacggtaccgtggagaagcgagaaaacgacaccgccaatgttcgacccgctagacctgccggtcttccacccgcaacttactatgactctctcgccgtgtcgggacagggcaaggagcgactgttcaccacagacgaggtcagacgacacattcttcccaccgatggatggctcacctgtcacgaaggtgtgtacgacgtcaccgatttcctggccaagcatcctggaggtggcgtcatcactctcggacttggtcgagactgcaccattctggtcgagtcctaccatcccgctggacgaccagacaaggtcatggagaagtaccgtatcggcacactccaggatcccaagactttctacgcttggggagaatcggacttttaccctgagctcaaacgacgggctcttgcacgactcaaggaggctggacaggcacgtcgaggtggactgggagtcaaggctctcctggtgcttaccctcttctttgtctcctggtacatgtgggttgcccacaagtctttcctgtgggctgccgtctggggctttgccggttcgcatgtcggactgagcattcaacacgatggcaaccacggtgctttctctcgatccaccctggtcaacagactcgcaggatggggcatggacttgatcggtgcctcgtccaccgtgtgggagtaccagcatgtcattggacaccatcagtacacgaatctcgtttccgatacgctgttcagccttcccgagaacgacccagatgtgttttccagctatcctctcatgcgaatgcatcccgacactgcttggcagcctcatcaccgatttcaacacctgttcgcctttcctctcttcgctcttatgaccatttccaaggtgctcaccagcgactttgctgtttgtctctccatgaaaaagggttctatcgactgttcgtccagactggttccactcgaaggccagctgttgttctggggagccaagctggcgaactttctcttgcagattgtgctgccctgctacctccacggaactgctatgggccttgctctgttctctgttgcccaccttgtgtctggagagtacctggccatctgtttcatcattaaccacatctccgagtcttgcgaatttatgaatacctcctttcaaactgctgcccgacggaccgagatgctccaggcagctcatcaggcagccgaggcgaaaaaggtcaagcccactcctccacccaacgattgggctgtgacacaagtccagtgctgtgtcaactggcgatctggaggcgtgctggccaatcacctctccggtggcctcaaccatcagatcgagcaccatctgtttcccagcatctctcacgcgaactatcccatcattgctcgagttgtcaaggaagtgtgcgaggaatacggattgccctacaagaactacgttacgttctgggatgccgtgtgtggcatggttcagcatctgcgactcatgggtgctcctcccgtgcctaccaacggcgacaaaaagtcctaa

SEQ ID NO: 388 - protein, 540 aa, Euglena gracilis
MVLFGNFYVKQYSQKNGKPENGATPENGAKPQPCENGTVEKRENDTANVRPARPAGLPPATYYDSLAVSGQGKERLFTTDEVRRHILPTDGWLTCHEGVYDVTDFLAKHPGGGVITLGLGRDCTILVESYHPAGRPDKVMEKYRIGTLQDPKTFYAWGESDFYPELKRRALARLKEAGQARRGGLGVKALLVLTLFFVSWYMWVAHKSFLWAAVWGFAGSHVGLSIQHDGNHGAFSRSTLVNRLAGWGMDLIGASSTVWEYQHVIGHHQYTNLVSDTLFSLPENDPDVFSSYPLMRMHPDTAWQPHHRFQHLFAFPLFALMTISKVLTSDFAVCLSMKKGSIDCSSRLVPLEGQLLFWGAKLANFLLQIVLPCYLHGTAMGLALFSVAHLVSGEYLAICFIINHISESCEFMNTSFQTAARRTEMLQAAHQAAEAKKVKPTPPPNDWAVTQVQCCVNWRSGGVLANHLSGGLNHQIEHHLFPSISHANYPIIARVVKEVCEEYGLPYKNYVTFWDAVCGMVQHLRLMGAPPVPTNGDKKS

SEQ ID NO: 389 - DNA, 4343 bp, Artificial Sequence
  Plasmid pEgD4S
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacctcgcgaatgcatctagatccatggtcctgttcggcaacttctacgtcaagcagtactcccagaagaacggaaagcccgagaacggtgccactcccgagaacggagccaaaccgcaaccttgcgagaacggtaccgtggagaagcgagaaaacgacaccgccaatgttcgacccgctagacctgccggtcttccacccgcaacttactatgactctctcgccgtgtcgggacagggcaaggagcgactgttcaccacagacgaggtcagacgacacattcttcccaccgatggatggctcacctgtcacgaaggtgtgtacgacgtcaccgatttcctggccaagcatcctggaggtggcgtcatcactctcggacttggtcgagactgcaccattctggtcgagtcctaccatcccgctggacgaccagacaaggtcatggagaagtaccgtatcggcacactccaggatcccaagactttctacgcttggggagaatcggacttttaccctgagctcaaacgacgggctcttgcacgactcaaggaggctggacaggcacgtcgaggtggactgggagtcaaggctctcctggtgcttaccctcttctttgtctcctggtacatgtgggttgcccacaagtctttcctgtgggctgccgtctggggctttgccggttcgcatgtcggactgagcattcaacacgatggcaaccacggtgctttctctcgatccaccctggtcaacagactcgcaggatggggcatggacttgatcggtgcctcgtccaccgtgtgggagtaccagcatgtcattggacaccatcagtacacgaatctcgtttccgatacgctgttcagccttcccgagaacgacccagatgtgttttccagctatcctctcatgcgaatgcatcccgacactgcttggcagcctcatcaccgatttcaacacctgttcgcctttcctctcttcgctcttatgaccatttccaaggtgctcaccagcgactttgctgtttgtctctccatgaaaaagggttctatcgactgttcgtccagactggttccactcgaaggccagctgttgttctggggagccaagctggcgaactttctcttgcagattgtgctgccctgctacctccacggaactgctatgggccttgctctgttctctgttgcccaccttgtgtctggagagtacctggccatctgtttcatcattaaccacatctccgagtcttgcgaatttatgaatacctcctttcaaactgctgcccgacggaccgagatgctccaggcagctcatcaggcagccgaggcgaaaaaggtcaagcccactcctccacccaacgattgggctgtgacacaagtccagtgctgtgtcaactggcgatctggaggcgtgctggccaatcacctctccggtggcctcaaccatcagatcgagcaccatctgtttcccagcatctctcacgcgaactatcccatcattgctcgagttgtcaaggaagtgtgcgaggaatacggattgccctacaagaactacgttacgttctgggatgccgtgtgtggcatggttcagcatctgcgactcatgggtgctcctcccgtgcctaccaacggcgacaaaaagtcctaagcggccgcatcggatcccgggcccgtcgactgcagaggcctgcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 390 - DNA, 13283 bp, Artificial Sequence
  Plasmid pZKL4-220Eg4
aaacagagtgtgaaagactcactatggtccgggcttatctcgaccaatagccaaagtctggagtttctgagagaaaaaggcaagatacgtatgtaacaaagcgacgcatggtacaataataccggaggcatgtatcatagagagttagtggttcgatgatggcactggtgcctggtatgactttatacggctgactacatatttgtcctcagacatacaattacagtcaagcacttacccttggacatctgtaggtaccccccggccaagacgatctcagcgtgtcgtatgtcggattggcgtagctccctcgctcgtcaattggctcccatctactttcttctgcttggctacacccagcatgtctgctatggctcgttttcgtgccttatctatcctcccagtattaccaactctaaatgacatgatgtgattgggtctacactttcatatcagagataaggagtagcacagttgcataaaaagcccaactctaatcagcttcttcctttcttgtaattagtacaaaggtgattagcgaaatctggaagcttagttggccctaaaaaaatcaaaaaaagcaaaaaacgaaaaacgaaaaaccacagttttgagaacagggaggtaacgaaggatcgtatatatatatatatatatatatacccacggatcccgagaccggcctttgattcttccctacaaccaaccattctcaccaccctaattcacaaccatggctgactctcccgtcatcaacctctccaccatgtggaagcctctgtcgctcatggccttggatcttgctgttctgggacacgtctggaagcaggcacaacaggagggctccatctcggcttacgccgactctgtgtggactcccctcatcatgtccggtctgtacctctccatgatcttcgtgggatgtcgatggatgaagaaccgagagcccttcgaaatcaagacctacatgtttgcctacaacctgtaccagaccctcatgaacctttgcattgtgctgggcttcctctaccaggtccacgctaccggtatgcgattctggggatctggcgtggaccgatcgcccaagggtctgggaattggctttttcatctatgcccattaccacaacaagtacgtcgagtacttcgacacactcttcatggtgctgcggaaaaagaacaaccagatttcctttcttcacgtctaccatcacgctctgctcacctgggcttggtttgccgtggtctacttcgctcctggaggtgacggctggtttggagcctgctacaattcctccattcatgtcctgatgtactcttactatctgcttgccaccttcggcatctcctgtccctggaaaaagatcctcacccagctgcaaatggttcagttctgcttttgcttcacccactcgatctacgtgtggatttgcggttccgaaatctaccctcgacccttgactgctctccagtccttcgtgatggtcaacatgctggttctctttggcaacttctacgtcaagcagtattctcagaagaatggaaagcccgagaacggtgccactcctgagaacggtgccaagcctcagccctgcgagaacggcaccgtcgagaagcgagagaacgacactgccaacgttcgataagcggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaactccgagccgtgagtatccacgacaagatcagtgtcgagacgacgcgttttgtgtaatgacacaatccgaaagtcgctagcaacacacactctctacacaaactaacccagctctggtaccatggccgagggcaagtccgacggtcccgtcgttaccctccagtccatgtggaagcccctggctctcatggccatcgacgtcggcatcctggtcaacgtgcgacggaaggccttcaccgagttcgacggacactcgaacgtcttcgccgatcccgtgtacattccctttgtcatgaacctgttctacctcaccatgatctttgctggctgccgatggatgaagactcgagaacccttcgagatcaagtcctacatgtttgcctacaacgcttaccagacaatgatgaactttctcattgtggtcggcttcatgtatgaggttcactccaccggtatgcgatactggggatccagaatcgacacttctaccaagggcttgggactgggtttcctcatctatgcccattaccacaacaagtacgtggagtacgtcgacaccctgttcatgattctgcggaagaaaaacaatcagatctcgttccttcacgtttaccaccattccctgctcacttgggcatggtgggctgtggtctactgggctcctggcggagatgcctggttcggtgcctgttacaactccttcatccacgttctcatgtactcctactatctgtttgccaccttcggcattcgatgtccctggaaaaagatgctcacccagttgcaaatggtccagttctgcttttgcttcgctcatgccatgtacgttggatggcttggtcacgaggtgtaccctcgatggctcactgctctgcaggcctttgtgatgctcaacatgctggtcctctttggcaacttctacatgaagtcttactccaaggcgagcaagctcgaaccagcctctcccgtgtcgcctgcctctcttgctcagaagcccttcgagaacgccaaggtcaagtaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgtagggatcaggtgcttaggaagctcgaccaaccacggagactgttgaaactggatgtcggtaacagcatctggaatgctgaatgttcctcgaataacaacatatttctccttgttgaggtgatcataagctatgtatccggtgattgaagtggaatagaagtctcctccgaagactgagtccaacgtcatgttcgggaaataccgacaactctctccacatgtaaaatcagttcgtagaggagtgactggcgcattgacacagtaggcgatgtttgcaatccgagaaaacttggccgtaaagttgtacagctcctgggaggcttgaactcgagtttttgaaagtgtcgctggtggctcgccgaagagggaggcatagaggtacgcaaccacttgcccgagcgtgaggttcatgatgccaatagtgaatgtcatttatcaccgtactgcgcagtatttatatagggctcatcggtccatgtatagatctgtccacttatgacacccccatgtctcattaatgtgtaaaggtggagacgggtggagtacaggtacagagttggaggaaatcaggatagtggggttaagacatgctccgagtccaaatttcaactctccattgtcacaagacctctggtttcagagttattacagatctaggcctgtttcaaggtgaggggacctcatctggatcggcacgacgatcgtcaccttacagaggacgtctgtcgcagggaaaggtgatgtggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgccaaggcgtatattagttggtgggaaccagtgtacgaccgggtcctgtataaccaggttcagtggcatacttgtaggagttgttcccgtggtatttgggcatggctaagacatttcgccgaccaatgttaagtgcacaatagccgatgtagtagatgtaagccagatggttttggagcaggtcgattcgagaccacagattgaaagtgcctcgatggcaggcctcgttttctcctccttcacagacagacactttgtcgagtgcagggtagacgctttcttggtcaatgtacacttctccaatggcgtgtgtgtaattggaccaatctggcagtccaacgaagatatcgttccagtgggtgagcctgtagtttcgtcgcttgtcgtttacttcaaggcctgtgtcattaaaccacagctggttgatgtagtttgcaaactctgagtttcctactctcggctggccaaagttgatcatggtaggatcatgtccaagtaatttgaagtgagttgcgaaaagaagagcttgagcagcgcccagcgagtgaccagtaacatacattttgtagtcagtgtggttggtgaggaacttttcaaactgaggagcagcattgaccatagtttcgttgaaggccttggcgaacccatcatggatcatgcagcctttgcactcactagttttgatgggaataagacgggggtcttcaaccaccagagcccgctctttgaggttgtcaagacctttgttctccacttccaagtctggtcggactgcccatctctgttaattaagttgcgacacatgtcttgatagtatcttgaattctctctcttgagcttttccataacaagttcttctgcctccaggaagtccatgggtggtttgatcatggttttggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgaccttttccttgggaaccaccaccgtcagcccttctgactcacgtattgtagccaccgacacaggcaacagtccgtggatagcagaatatgtcttgtcggtccatttctcaccaactttaggcgtcaagtgaatgttgcagaagaagtatgtgccttcattgagaatcggtgttgctgatttcaataaagtcttgagatcagtttggccagtcatgttgtggggggtaattggattgagttatcgcctacagtctgtacaggtatactcgctgcccactttatactttttgattccgctgcacttgaagcaatgtcgtttaccaaaagtgagaatgctccacagaacacaccccagggtatggttgagcaaaaaataaacactccgatacggggaatcgaaccccggtctccacggttctcaagaagtattcttgatgagagcgtatcgatcgaggaagaggacaagcggctgcttcttaagtttgtgacatcagtatccaaggcaccattgcaaggattcaaggctttgaacccgtcatttgccattcgtaacgctggtagacaggttgatcggttccctacggcctccacctgtgtcaatcttctcaagctgcctgactatcaggacattgatcaacttcggaagaaacttttgtatgccattcgatcacatgctggtttcgatttgtcttagaggaacgcatatacagtaatcatagagaataaacgatattcatttattaaagtagatagttgaggtagaagttgtaaagagtgataaatagcggccgcttaggactttttgtcgccgttggtaggcacgggaggagcacccatgagtcgcagatgctgaaccatgccacacacggcatcccagaacgtaacgtagttcttgtagggcaatccgtattcctcgcacacttccttgacaactcgagcaatgatgggatagttcgcgtgagagatgctgggaaacagatggtgctcgatctgatggttgaggccaccggagaggtgattggccagcacgcctccagatcgccagttgacacagcactggacttgtgtcacagcccaatcgttgggtggaggagtgggcttgacctttttcgcctcggctgcctgatgagctgcctggagcatctcggtccgtcgggcagcagtttgaaaggaggtattcataaattcgcaagactcggagatgtggttaatgatgaaacagatggccaggtactctccagacacaaggtgggcaacagagaacagagcaaggcccatagcagttccgtggaggtagcagggcagcacaatctgcaagagaaagttcgccagcttggctccccagaacaacagctggccttcgagtggaaccagtctggacgaacagtcgatagaaccctttttcatggagagacaaacagcaaagtcgctggtgagcaccttggaaatggtcataagagcgaagagaggaaaggcgaacaggtgttgaaatcggtgatgaggctgccaagcagtgtcgggatgcattcgcatgagaggatagctggaaaacacatctgggtcgttctcgggaaggctgaacagcgtatcggaaacgagattcgtgtactgatggtgtccaatgacatgctggtactcccacacggtggacgaggcaccgatcaagtccatgccccatcctgcgagtctgttgaccagggtggatcgagagaaagcaccgtggttgccatcgtgttgaatgctcagtccgacatgcgaaccggcaaagccccagacggcagcccacaggaaagacttgtgggcaacccacatgtaccaggagacaaagaagagggtaagcaccaggagagccttgactcccagtccacctcgacgtgcctgtccagcctccttgagtcgtgcaagagcccgtcgtttgagctcagggtaaaagtccgattctccccaagcgtagaaagtcttgggatcctggagtgtgccgatacggtacttctccatgaccttgtctggtcgtccagcgggatggtaggactcgaccagaatggtgcagtctcgaccaagtccgagagtgatgacgccacctccaggatgcttggccaggaaatcggtgacgtcgtacacaccttcgtgacaggtgagccatccatcggtgggaagaatgtgtcgtctgacctcgtctgtggtgaacagtcgctccttgccctgtcccgacacggcgagagagtcatagtaagttgcgggtggaagaccggcaggtctagcgggtcgaacattggcggtgtcgttttctcgcttctccacggtaccgttctcgcaaggttgcggtttggctccgttctcgggagtggcaccgttctcgggctttccgttcttctgggagtactgcttgacgtagaagttgccgaacaggaccatggccattgctgtagatatgtcttgtgtgtaagggggttggggtggttgtttgtgttcttgacttttgtgttagcaagggaagacgggcaaaaaagtgagtgtggttgggagggagagacgagccttatatataatgcttgtttgtgtttgtgcaagtggacgccgaaacgggcaggagccaaactaaacaaggcagacaatgcgagcttaattggattgcctgatgggcaggggttagggctcgatcaatgggggtgcgaagtgacaaaattgggaattaggttcgcaagcaaggctgacaagactttggcccaaacatttgtacgcggtggacaacaggagccacccatcgtctgtcacgggctagccggtcgtgcgtcctgtcaggctccacctaggctccatgccactccatacaatcccactagtgtaccgctaggccgcttttagctcccatctaagacccccccaaaacctccactgtacagtgcactgtactgtgtggcgatcaagggcaagggaaaaaaggcgcaaacatgcacgcatggaatgacgtaggtaaggcgttactagactgaaaagtggcacatttcggcgtgccaaagggtcctaggtgcgtttcgcgagctgggcgccaggccaagccgctccaaaacgcctctccgactccctccagcggcctccatatccccatccctctccacagcaatgttgttaagccttgcaaacgaaaaaatagaaaggctaataagcttccaatattgtggtgtacgctgcataacgcaacaatgagcgccaaacaacacacacacacagcacacagcagcattaaccacgatgttt

SEQ ID NO: 391 - DNA, 38 bp, Artificial Sequence
  Primer YL935
gtgccactcccgagaaccatggccaaaccgcaaccttg

SEQ ID NO: 392 - DNA, 38 bp, Artificial Sequence
  Primer YL936
caaggttgcggtttggccatggttctcgggagtggcac

SEQ ID NO: 393 - DNA, 40 bp, Artificial Sequence
  Primer YL937
accgccaatgttcgacccatggctagacctgccggtcttc

SEQ ID NO: 394 - DNA, 40 bp, Artificial Sequence
  Primer YL938
gaagaccggcaggtctagccatgggtcgaacattggcggt

SEQ ID NO: 395 - DNA, 37 bp, Artificial Sequence
  Primer YL939
actatgactctctcgccatggtgtcgggacagggcaa

SEQ ID NO: 396 - DNA, 37 bp, Artificial Sequence
  Primer YL940
ttgccctgtcccgacaccatggcgagagagtcatagt

SEQ ID NO: 397 - DNA, 4344 bp, Artificial Sequence
  Plasmid pEgD4S-M1
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacctcgcgaatgcatctagatccatggtcctgttcggcaacttctacgtcaagcagtactcccagaagaacggaaagcccgagaacggtgccactcccgagaaccatggccaaaccgcaaccttgcgagaacggtaccgtggagaagcgagaaaacgacaccgccaatgttcgacccgctagacctgccggtcttccacccgcaacttactatgactctctcgccgtgtcgggacagggcaaggagcgactgttcaccacagacgaggtcagacgacacattcttcccaccgatggatggctcacctgtcacgaaggtgtgtacgacgtcaccgatttcctggccaagcatcctggaggtggcgtcatcactctcggacttggtcgagactgcaccattctggtcgagtcctaccatcccgctggacgaccagacaaggtcatggagaagtaccgtatcggcacactccaggatcccaagactttctacgcttggggagaatcggacttttaccctgagctcaaacgacgggctcttgcacgactcaaggaggctggacaggcacgtcgaggtggactgggagtcaaggctctcctggtgcttaccctcttctttgtctcctggtacatgtgggttgcccacaagtctttcctgtgggctgccgtctggggctttgccggttcgcatgtcggactgagcattcaacacgatggcaaccacggtgctttctctcgatccaccctggtcaacagactcgcaggatggggcatggacttgatcggtgcctcgtccaccgtgtgggagtaccagcatgtcattggacaccatcagtacacgaatctcgtttccgatacgctgttcagccttcccgagaacgacccagatgtgttttccagctatcctctcatgcgaatgcatcccgacactgcttggcagcctcatcaccgatttcaacacctgttcgcctttcctctcttcgctcttatgaccatttccaaggtgctcaccagcgactttgctgtttgtctctccatgaaaaagggttctatcgactgttcgtccagactggttccactcgaaggccagctgttgttctggggagccaagctggcgaactttctcttgcagattgtgctgccctgctacctccacggaactgctatgggccttgctctgttctctgttgcccaccttgtgtctggagagtacctggccatctgtttcatcattaaccacatctccgagtcttgcgaatttatgaatacctcctttcaaactgctgcccgacggaccgagatgctccaggcagctcatcaggcagccgaggcgaaaaaggtcaagcccactcctccacccaacgattgggctgtgacacaagtccagtgctgtgtcaactggcgatctggaggcgtgctggccaatcacctctccggtggcctcaaccatcagatcgagcaccatctgtttcccagcatctctcacgcgaactatcccatcattgctcgagttgtcaaggaagtgtgcgaggaatacggattgccctacaagaactacgttacgttctgggatgccgtgtgtggcatggttcagcatctgcgactcatgggtgctcctcccgtgcctaccaacggcgacaaaaagtcctaagcggccgcatcggatcccgggcccgtcgactgcagaggcctgcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 398 - DNA, 4346 bp, Artificial Sequence
  Plasmid pEgD4S-M2
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacctcgcgaatgcatctagatccatggtcctgttcggcaacttctacgtcaagcagtactcccagaagaacggaaagcccgagaacggtgccactcccgagaacggagccaaaccgcaaccttgcgagaacggtaccgtggagaagcgagaaaacgacaccgccaatgttcgacccatggctagacctgccggtcttccacccgcaacttactatgactctctcgccgtgtcgggacagggcaaggagcgactgttcaccacagacgaggtcagacgacacattcttcccaccgatggatggctcacctgtcacgaaggtgtgtacgacgtcaccgatttcctggccaagcatcctggaggtggcgtcatcactctcggacttggtcgagactgcaccattctggtcgagtcctaccatcccgctggacgaccagacaaggtcatggagaagtaccgtatcggcacactccaggatcccaagactttctacgcttggggagaatcggacttttaccctgagctcaaacgacgggctcttgcacgactcaaggaggctggacaggcacgtcgaggtggactgggagtcaaggctctcctggtgcttaccctcttctttgtctcctggtacatgtgggttgcccacaagtctttcctgtgggctgccgtctggggctttgccggttcgcatgtcggactgagcattcaacacgatggcaaccacggtgctttctctcgatccaccctggtcaacagactcgcaggatggggcatggacttgatcggtgcctcgtccaccgtgtgggagtaccagcatgtcattggacaccatcagtacacgaatctcgtttccgatacgctgttcagccttcccgagaacgacccagatgtgttttccagctatcctctcatgcgaatgcatcccgacactgcttggcagcctcatcaccgatttcaacacctgttcgcctttcctctcttcgctcttatgaccatttccaaggtgctcaccagcgactttgctgtttgtctctccatgaaaaagggttctatcgactgttcgtccagactggttccactcgaaggccagctgttgttctggggagccaagctggcgaactttctcttgcagattgtgctgccctgctacctccacggaactgctatgggccttgctctgttctctgttgcccaccttgtgtctggagagtacctggccatctgtttcatcattaaccacatctccgagtcttgcgaatttatgaatacctcctttcaaactgctgcccgacggaccgagatgctccaggcagctcatcaggcagccgaggcgaaaaaggtcaagcccactcctccacccaacgattgggctgtgacacaagtccagtgctgtgtcaactggcgatctggaggcgtgctggccaatcacctctccggtggcctcaaccatcagatcgagcaccatctgtttcccagcatctctcacgcgaactatcccatcattgctcgagttgtcaaggaagtgtgcgaggaatacggattgccctacaagaactacgttacgttctgggatgccgtgtgtggcatggttcagcatctgcgactcatgggtgctcctcccgtgcctaccaacggcgacaaaaagtcctaagcggccgcatcggatcccgggcccgtcgactgcagaggcctgcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 399 - DNA, 4346 bp, Artificial Sequence
  Plasmid pEgD4S-M3
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacctcgcgaatgcatctagatccatggtcctgttcggcaacttctacgtcaagcagtactcccagaagaacggaaagcccgagaacggtgccactcccgagaacggagccaaaccgcaaccttgcgagaacggtaccgtggagaagcgagaaaacgacaccgccaatgttcgacccgctagacctgccggtcttccacccgcaacttactatgactctctcgccatggtgtcgggacagggcaaggagcgactgttcaccacagacgaggtcagacgacacattcttcccaccgatggatggctcacctgtcacgaaggtgtgtacgacgtcaccgatttcctggccaagcatcctggaggtggcgtcatcactctcggacttggtcgagactgcaccattctggtcgagtcctaccatcccgctggacgaccagacaaggtcatggagaagtaccgtatcggcacactccaggatcccaagactttctacgcttggggagaatcggacttttaccctgagctcaaacgacgggctcttgcacgactcaaggaggctggacaggcacgtcgaggtggactgggagtcaaggctctcctggtgcttaccctcttctttgtctcctggtacatgtgggttgcccacaagtctttcctgtgggctgccgtctggggctttgccggttcgcatgtcggactgagcattcaacacgatggcaaccacggtgctttctctcgatccaccctggtcaacagactcgcaggatggggcatggacttgatcggtgcctcgtccaccgtgtgggagtaccagcatgtcattggacaccatcagtacacgaatctcgtttccgatacgctgttcagccttcccgagaacgacccagatgtgttttccagctatcctctcatgcgaatgcatcccgacactgcttggcagcctcatcaccgatttcaacacctgttcgcctttcctctcttcgctcttatgaccatttccaaggtgctcaccagcgactttgctgtttgtctctccatgaaaaagggttctatcgactgttcgtccagactggttccactcgaaggccagctgttgttctggggagccaagctggcgaactttctcttgcagattgtgctgccctgctacctccacggaactgctatgggccttgctctgttctctgttgcccaccttgtgtctggagagtacctggccatctgtttcatcattaaccacatctccgagtcttgcgaatttatgaatacctcctttcaaactgctgcccgacggaccgagatgctccaggcagctcatcaggcagccgaggcgaaaaaggtcaagcccactcctccacccaacgattgggctgtgacacaagtccagtgctgtgtcaactggcgatctggaggcgtgctggccaatcacctctccggtggcctcaaccatcagatcgagcaccatctgtttcccagcatctctcacgcgaactatcccatcattgctcgagttgtcaaggaagtgtgcgaggaatacggattgccctacaagaactacgttacgttctgggatgccgtgtgtggcatggttcagcatctgcgactcatgggtgctcctcccgtgcctaccaacggcgacaaaaagtcctaagcggccgcatcggatcccgggcccgtcgactgcagaggcctgcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 400 - DNA, 13202 bp, Artificial Sequence
  Plasmid pZKL4-220Eg4-1
catggccattgctgtagatatgtcttgtgtgtaagggggttggggtggttgtttgtgttcttgacttttgtgttagcaagggaagacgggcaaaaaagtgagtgtggttgggagggagagacgagccttatatataatgcttgtttgtgtttgtgcaagtggacgccgaaacgggcaggagccaaactaaacaaggcagacaatgcgagcttaattggattgcctgatgggcaggggttagggctcgatcaatgggggtgcgaagtgacaaaattgggaattaggttcgcaagcaaggctgacaagactttggcccaaacatttgtacgcggtggacaacaggagccacccatcgtctgtcacgggctagccggtcgtgcgtcctgtcaggctccacctaggctccatgccactccatacaatcccactagtgtaccgctaggccgcttttagctcccatctaagacccccccaaaacctccactgtacagtgcactgtactgtgtggcgatcaagggcaagggaaaaaaggcgcaaacatgcacgcatggaatgacgtaggtaaggcgttactagactgaaaagtggcacatttcggcgtgccaaagggtcctaggtgcgtttcgcgagctgggcgccaggccaagccgctccaaaacgcctctccgactccctccagcggcctccatatccccatccctctccacagcaatgttgttaagccttgcaaacgaaaaaatagaaaggctaataagcttccaatattgtggtgtacgctgcataacgcaacaatgagcgccaaacaacacacacacacagcacacagcagcattaaccacgatgtttaaacagagtgtgaaagactcactatggtccgggcttatctcgaccaatagccaaagtctggagtttctgagagaaaaaggcaagatacgtatgtaacaaagcgacgcatggtacaataataccggaggcatgtatcatagagagttagtggttcgatgatggcactggtgcctggtatgactttatacggctgactacatatttgtcctcagacatacaattacagtcaagcacttacccttggacatctgtaggtaccccccggccaagacgatctcagcgtgtcgtatgtcggattggcgtagctccctcgctcgtcaattggctcccatctactttcttctgcttggctacacccagcatgtctgctatggctcgttttcgtgccttatctatcctcccagtattaccaactctaaatgacatgatgtgattgggtctacactttcatatcagagataaggagtagcacagttgcataaaaagcccaactctaatcagcttcttcctttcttgtaattagtacaaaggtgattagcgaaatctggaagcttagttggccctaaaaaaatcaaaaaaagcaaaaaacgaaaaacgaaaaaccacagttttgagaacagggaggtaacgaaggatcgtatatatatatatatatatatatacccacggatcccgagaccggcctttgattcttccctacaaccaaccattctcaccaccctaattcacaaccatggctgactctcccgtcatcaacctctccaccatgtggaagcctctgtcgctcatggccttggatcttgctgttctgggacacgtctggaagcaggcacaacaggagggctccatctcggcttacgccgactctgtgtggactcccctcatcatgtccggtctgtacctctccatgatcttcgtgggatgtcgatggatgaagaaccgagagcccttcgaaatcaagacctacatgtttgcctacaacctgtaccagaccctcatgaacctttgcattgtgctgggcttcctctaccaggtccacgctaccggtatgcgattctggggatctggcgtggaccgatcgcccaagggtctgggaattggctttttcatctatgcccattaccacaacaagtacgtcgagtacttcgacacactcttcatggtgctgcggaaaaagaacaaccagatttcctttcttcacgtctaccatcacgctctgctcacctgggcttggtttgccgtggtctacttcgctcctggaggtgacggctggtttggagcctgctacaattcctccattcatgtcctgatgtactcttactatctgcttgccaccttcggcatctcctgtccctggaaaaagatcctcacccagctgcaaatggttcagttctgcttttgcttcacccactcgatctacgtgtggatttgcggttccgaaatctaccctcgacccttgactgctctccagtccttcgtgatggtcaacatgctggttctctttggcaacttctacgtcaagcagtattctcagaagaatggaaagcccgagaacggtgccactcctgagaacggtgccaagcctcagccctgcgagaacggcaccgtcgagaagcgagagaacgacactgccaacgttcgataagcggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaactccgagccgtgagtatccacgacaagatcagtgtcgagacgacgcgttttgtgtaatgacacaatccgaaagtcgctagcaacacacactctctacacaaactaacccagctctggtaccatggccgagggcaagtccgacggtcccgtcgttaccctccagtccatgtggaagcccctggctctcatggccatcgacgtcggcatcctggtcaacgtgcgacggaaggccttcaccgagttcgacggacactcgaacgtcttcgccgatcccgtgtacattccctttgtcatgaacctgttctacctcaccatgatctttgctggctgccgatggatgaagactcgagaacccttcgagatcaagtcctacatgtttgcctacaacgcttaccagacaatgatgaactttctcattgtggtcggcttcatgtatgaggttcactccaccggtatgcgatactggggatccagaatcgacacttctaccaagggcttgggactgggtttcctcatctatgcccattaccacaacaagtacgtggagtacgtcgacaccctgttcatgattctgcggaagaaaaacaatcagatctcgttccttcacgtttaccaccattccctgctcacttgggcatggtgggctgtggtctactgggctcctggcggagatgcctggttcggtgcctgttacaactccttcatccacgttctcatgtactcctactatctgtttgccaccttcggcattcgatgtccctggaaaaagatgctcacccagttgcaaatggtccagttctgcttttgcttcgctcatgccatgtacgttggatggcttggtcacgaggtgtaccctcgatggctcactgctctgcaggcctttgtgatgctcaacatgctggtcctctttggcaacttctacatgaagtcttactccaaggcgagcaagctcgaaccagcctctcccgtgtcgcctgcctctcttgctcagaagcccttcgagaacgccaaggtcaagtaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgtagggatcaggtgcttaggaagctcgaccaaccacggagactgttgaaactggatgtcggtaacagcatctggaatgctgaatgttcctcgaataacaacatatttctccttgttgaggtgatcataagctatgtatccggtgattgaagtggaatagaagtctcctccgaagactgagtccaacgtcatgttcgggaaataccgacaactctctccacatgtaaaatcagttcgtagaggagtgactggcgcattgacacagtaggcgatgtttgcaatccgagaaaacttggccgtaaagttgtacagctcctgggaggcttgaactcgagtttttgaaagtgtcgctggtggctcgccgaagagggaggcatagaggtacgcaaccacttgcccgagcgtgaggttcatgatgccaatagtgaatgtcatttatcaccgtactgcgcagtatttatatagggctcatcggtccatgtatagatctgtccacttatgacacccccatgtctcattaatgtgtaaaggtggagacgggtggagtacaggtacagagttggaggaaatcaggatagtggggttaagacatgctccgagtccaaatttcaactctccattgtcacaagacctctggtttcagagttattacagatctaggcctgtttcaaggtgaggggacctcatctggatcggcacgacgatcgtcaccttacagaggacgtctgtcgcagggaaaggtgatgtggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgccaaggcgtatattagttggtgggaaccagtgtacgaccgggtcctgtataaccaggttcagtggcatacttgtaggagttgttcccgtggtatttgggcatggctaagacatttcgccgaccaatgttaagtgcacaatagccgatgtagtagatgtaagccagatggttttggagcaggtcgattcgagaccacagattgaaagtgcctcgatggcaggcctcgttttctcctccttcacagacagacactttgtcgagtgcagggtagacgctttcttggtcaatgtacacttctccaatggcgtgtgtgtaattggaccaatctggcagtccaacgaagatatcgttccagtgggtgagcctgtagtttcgtcgcttgtcgtttacttcaaggcctgtgtcattaaaccacagctggttgatgtagtttgcaaactctgagtttcctactctcggctggccaaagttgatcatggtaggatcatgtccaagtaatttgaagtgagttgcgaaaagaagagcttgagcagcgcccagcgagtgaccagtaacatacattttgtagtcagtgtggttggtgaggaacttttcaaactgaggagcagcattgaccatagtttcgttgaaggccttggcgaacccatcatggatcatgcagcctttgcactcactagttttgatgggaataagacgggggtcttcaaccaccagagcccgctctttgaggttgtcaagacctttgttctccacttccaagtctggtcggactgcccatctctgttaattaagttgcgacacatgtcttgatagtatcttgaattctctctcttgagcttttccataacaagttcttctgcctccaggaagtccatgggtggtttgatcatggttttggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgaccttttccttgggaaccaccaccgtcagcccttctgactcacgtattgtagccaccgacacaggcaacagtccgtggatagcagaatatgtcttgtcggtccatttctcaccaactttaggcgtcaagtgaatgttgcagaagaagtatgtgccttcattgagaatcggtgttgctgatttcaataaagtcttgagatcagtttggccagtcatgttgtggggggtaattggattgagttatcgcctacagtctgtacaggtatactcgctgcccactttatactttttgattccgctgcacttgaagcaatgtcgtttaccaaaagtgagaatgctccacagaacacaccccagggtatggttgagcaaaaaataaacactccgatacggggaatcgaaccccggtctccacggttctcaagaagtattcttgatgagagcgtatcgatcgaggaagaggacaagcggctgcttcttaagtttgtgacatcagtatccaaggcaccattgcaaggattcaaggctttgaacccgtcatttgccattcgtaacgctggtagacaggttgatcggttccctacggcctccacctgtgtcaatcttctcaagctgcctgactatcaggacattgatcaacttcggaagaaacttttgtatgccattcgatcacatgctggtttcgatttgtcttagaggaacgcatatacagtaatcatagagaataaacgatattcatttattaaagtagatagttgaggtagaagttgtaaagagtgataaatagcggccgcttaggactttttgtcgccgttggtaggcacgggaggagcacccatgagtcgcagatgctgaaccatgccacacacggcatcccagaacgtaacgtagttcttgtagggcaatccgtattcctcgcacacttccttgacaactcgagcaatgatgggatagttcgcgtgagagatgctgggaaacagatggtgctcgatctgatggttgaggccaccggagaggtgattggccagcacgcctccagatcgccagttgacacagcactggacttgtgtcacagcccaatcgttgggtggaggagtgggcttgacctttttcgcctcggctgcctgatgagctgcctggagcatctcggtccgtcgggcagcagtttgaaaggaggtattcataaattcgcaagactcggagatgtggttaatgatgaaacagatggccaggtactctccagacacaaggtgggcaacagagaacagagcaaggcccatagcagttccgtggaggtagcagggcagcacaatctgcaagagaaagttcgccagcttggctccccagaacaacagctggccttcgagtggaaccagtctggacgaacagtcgatagaaccctttttcatggagagacaaacagcaaagtcgctggtgagcaccttggaaatggtcataagagcgaagagaggaaaggcgaacaggtgttgaaatcggtgatgaggctgccaagcagtgtcgggatgcattcgcatgagaggatagctggaaaacacatctgggtcgttctcgggaaggctgaacagcgtatcggaaacgagattcgtgtactgatggtgtccaatgacatgctggtactcccacacggtggacgaggcaccgatcaagtccatgccccatcctgcgagtctgttgaccagggtggatcgagagaaagcaccgtggttgccatcgtgttgaatgctcagtccgacatgcgaaccggcaaagccccagacggcagcccacaggaaagacttgtgggcaacccacatgtaccaggagacaaagaagagggtaagcaccaggagagccttgactcccagtccacctcgacgtgcctgtccagcctccttgagtcgtgcaagagcccgtcgtttgagctcagggtaaaagtccgattctccccaagcgtagaaagtcttgggatcctggagtgtgccgatacggtacttctccatgaccttgtctggtcgtccagcgggatggtaggactcgaccagaatggtgcagtctcgaccaagtccgagagtgatgacgccacctccaggatgcttggccaggaaatcggtgacgtcgtacacaccttcgtgacaggtgagccatccatcggtgggaagaatgtgtcgtctgacctcgtctgtggtgaacagtcgctccttgccctgtcccgacacggcgagagagtcatagtaagttgcgggtggaagaccggcaggtctagcgggtcgaacattggcggtgtcgttttctcgcttctccacggtaccgttctcgcaaggttgcggtttggc

SEQ ID NO: 401 - DNA, 13133 bp, Artificial Sequence
  Plasmid pZKL4-220Eg4-2
catggccattgctgtagatatgtcttgtgtgtaagggggttggggtggttgtttgtgttcttgacttttgtgttagcaagggaagacgggcaaaaaagtgagtgtggttgggagggagagacgagccttatatataatgcttgtttgtgtttgtgcaagtggacgccgaaacgggcaggagccaaactaaacaaggcagacaatgcgagcttaattggattgcctgatgggcaggggttagggctcgatcaatgggggtgcgaagtgacaaaattgggaattaggttcgcaagcaaggctgacaagactttggcccaaacatttgtacgcggtggacaacaggagccacccatcgtctgtcacgggctagccggtcgtgcgtcctgtcaggctccacctaggctccatgccactccatacaatcccactagtgtaccgctaggccgcttttagctcccatctaagacccccccaaaacctccactgtacagtgcactgtactgtgtggcgatcaagggcaagggaaaaaaggcgcaaacatgcacgcatggaatgacgtaggtaaggcgttactagactgaaaagtggcacatttcggcgtgccaaagggtcctaggtgcgtttcgcgagctgggcgccaggccaagccgctccaaaacgcctctccgactccctccagcggcctccatatccccatccctctccacagcaatgttgttaagccttgcaaacgaaaaaatagaaaggctaataagcttccaatattgtggtgtacgctgcataacgcaacaatgagcgccaaacaacacacacacacagcacacagcagcattaaccacgatgtttaaacagagtgtgaaagactcactatggtccgggcttatctcgaccaatagccaaagtctggagtttctgagagaaaaaggcaagatacgtatgtaacaaagcgacgcatggtacaataataccggaggcatgtatcatagagagttagtggttcgatgatggcactggtgcctggtatgactttatacggctgactacatatttgtcctcagacatacaattacagtcaagcacttacccttggacatctgtaggtaccccccggccaagacgatctcagcgtgtcgtatgtcggattggcgtagctccctcgctcgtcaattggctcccatctactttcttctgcttggctacacccagcatgtctgctatggctcgttttcgtgccttatctatcctcccagtattaccaactctaaatgacatgatgtgattgggtctacactttcatatcagagataaggagtagcacagttgcataaaaagcccaactctaatcagcttcttcctttcttgtaattagtacaaaggtgattagcgaaatctggaagcttagttggccctaaaaaaatcaaaaaaagcaaaaaacgaaaaacgaaaaaccacagttttgagaacagggaggtaacgaaggatcgtatatatatatatatatatatatacccacggatcccgagaccggcctttgattcttccctacaaccaaccattctcaccaccctaattcacaaccatggctgactctcccgtcatcaacctctccaccatgtggaagcctctgtcgctcatggccttggatcttgctgttctgggacacgtctggaagcaggcacaacaggagggctccatctcggcttacgccgactctgtgtggactcccctcatcatgtccggtctgtacctctccatgatcttcgtgggatgtcgatggatgaagaaccgagagcccttcgaaatcaagacctacatgtttgcctacaacctgtaccagaccctcatgaacctttgcattgtgctgggcttcctctaccaggtccacgctaccggtatgcgattctggggatctggcgtggaccgatcgcccaagggtctgggaattggctttttcatctatgcccattaccacaacaagtacgtcgagtacttcgacacactcttcatggtgctgcggaaaaagaacaaccagatttcctttcttcacgtctaccatcacgctctgctcacctgggcttggtttgccgtggtctacttcgctcctggaggtgacggctggtttggagcctgctacaattcctccattcatgtcctgatgtactcttactatctgcttgccaccttcggcatctcctgtccctggaaaaagatcctcacccagctgcaaatggttcagttctgcttttgcttcacccactcgatctacgtgtggatttgcggttccgaaatctaccctcgacccttgactgctctccagtccttcgtgatggtcaacatgctggttctctttggcaacttctacgtcaagcagtattctcagaagaatggaaagcccgagaacggtgccactcctgagaacggtgccaagcctcagccctgcgagaacggcaccgtcgagaagcgagagaacgacactgccaacgttcgataagcggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaactccgagccgtgagtatccacgacaagatcagtgtcgagacgacgcgttttgtgtaatgacacaatccgaaagtcgctagcaacacacactctctacacaaactaacccagctctggtaccatggccgagggcaagtccgacggtcccgtcgttaccctccagtccatgtggaagcccctggctctcatggccatcgacgtcggcatcctggtcaacgtgcgacggaaggccttcaccgagttcgacggacactcgaacgtcttcgccgatcccgtgtacattccctttgtcatgaacctgttctacctcaccatgatctttgctggctgccgatggatgaagactcgagaacccttcgagatcaagtcctacatgtttgcctacaacgcttaccagacaatgatgaactttctcattgtggtcggcttcatgtatgaggttcactccaccggtatgcgatactggggatccagaatcgacacttctaccaagggcttgggactgggtttcctcatctatgcccattaccacaacaagtacgtggagtacgtcgacaccctgttcatgattctgcggaagaaaaacaatcagatctcgttccttcacgtttaccaccattccctgctcacttgggcatggtgggctgtggtctactgggctcctggcggagatgcctggttcggtgcctgttacaactccttcatccacgttctcatgtactcctactatctgtttgccaccttcggcattcgatgtccctggaaaaagatgctcacccagttgcaaatggtccagttctgcttttgcttcgctcatgccatgtacgttggatggcttggtcacgaggtgtaccctcgatggctcactgctctgcaggcctttgtgatgctcaacatgctggtcctctttggcaacttctacatgaagtcttactccaaggcgagcaagctcgaaccagcctctcccgtgtcgcctgcctctcttgctcagaagcccttcgagaacgccaaggtcaagtaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgtagggatcaggtgcttaggaagctcgaccaaccacggagactgttgaaactggatgtcggtaacagcatctggaatgctgaatgttcctcgaataacaacatatttctccttgttgaggtgatcataagctatgtatccggtgattgaagtggaatagaagtctcctccgaagactgagtccaacgtcatgttcgggaaataccgacaactctctccacatgtaaaatcagttcgtagaggagtgactggcgcattgacacagtaggcgatgtttgcaatccgagaaaacttggccgtaaagttgtacagctcctgggaggcttgaactcgagtttttgaaagtgtcgctggtggctcgccgaagagggaggcatagaggtacgcaaccacttgcccgagcgtgaggttcatgatgccaatagtgaatgtcatttatcaccgtactgcgcagtatttatatagggctcatcggtccatgtatagatctgtccacttatgacacccccatgtctcattaatgtgtaaaggtggagacgggtggagtacaggtacagagttggaggaaatcaggatagtggggttaagacatgctccgagtccaaatttcaactctccattgtcacaagacctctggtttcagagttattacagatctaggcctgtttcaaggtgaggggacctcatctggatcggcacgacgatcgtcaccttacagaggacgtctgtcgcagggaaaggtgatgtggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgccaaggcgtatattagttggtgggaaccagtgtacgaccgggtcctgtataaccaggttcagtggcatacttgtaggagttgttcccgtggtatttgggcatggctaagacatttcgccgaccaatgttaagtgcacaatagccgatgtagtagatgtaagccagatggttttggagcaggtcgattcgagaccacagattgaaagtgcctcgatggcaggcctcgttttctcctccttcacagacagacactttgtcgagtgcagggtagacgctttcttggtcaatgtacacttctccaatggcgtgtgtgtaattggaccaatctggcagtccaacgaagatatcgttccagtgggtgagcctgtagtttcgtcgcttgtcgtttacttcaaggcctgtgtcattaaaccacagctggttgatgtagtttgcaaactctgagtttcctactctcggctggccaaagttgatcatggtaggatcatgtccaagtaatttgaagtgagttgcgaaaagaagagcttgagcagcgcccagcgagtgaccagtaacatacattttgtagtcagtgtggttggtgaggaacttttcaaactgaggagcagcattgaccatagtttcgttgaaggccttggcgaacccatcatggatcatgcagcctttgcactcactagttttgatgggaataagacgggggtcttcaaccaccagagcccgctctttgaggttgtcaagacctttgttctccacttccaagtctggtcggactgcccatctctgttaattaagttgcgacacatgtcttgatagtatcttgaattctctctcttgagcttttccataacaagttcttctgcctccaggaagtccatgggtggtttgatcatggttttggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgaccttttccttgggaaccaccaccgtcagcccttctgactcacgtattgtagccaccgacacaggcaacagtccgtggatagcagaatatgtcttgtcggtccatttctcaccaactttaggcgtcaagtgaatgttgcagaagaagtatgtgccttcattgagaatcggtgttgctgatttcaataaagtcttgagatcagtttggccagtcatgttgtggggggtaattggattgagttatcgcctacagtctgtacaggtatactcgctgcccactttatactttttgattccgctgcacttgaagcaatgtcgtttaccaaaagtgagaatgctccacagaacacaccccagggtatggttgagcaaaaaataaacactccgatacggggaatcgaaccccggtctccacggttctcaagaagtattcttgatgagagcgtatcgatcgaggaagaggacaagcggctgcttcttaagtttgtgacatcagtatccaaggcaccattgcaaggattcaaggctttgaacccgtcatttgccattcgtaacgctggtagacaggttgatcggttccctacggcctccacctgtgtcaatcttctcaagctgcctgactatcaggacattgatcaacttcggaagaaacttttgtatgccattcgatcacatgctggtttcgatttgtcttagaggaacgcatatacagtaatcatagagaataaacgatattcatttattaaagtagatagttgaggtagaagttgtaaagagtgataaatagcggccgcttaggactttttgtcgccgttggtaggcacgggaggagcacccatgagtcgcagatgctgaaccatgccacacacggcatcccagaacgtaacgtagttcttgtagggcaatccgtattcctcgcacacttccttgacaactcgagcaatgatgggatagttcgcgtgagagatgctgggaaacagatggtgctcgatctgatggttgaggccaccggagaggtgattggccagcacgcctccagatcgccagttgacacagcactggacttgtgtcacagcccaatcgttgggtggaggagtgggcttgacctttttcgcctcggctgcctgatgagctgcctggagcatctcggtccgtcgggcagcagtttgaaaggaggtattcataaattcgcaagactcggagatgtggttaatgatgaaacagatggccaggtactctccagacacaaggtgggcaacagagaacagagcaaggcccatagcagttccgtggaggtagcagggcagcacaatctgcaagagaaagttcgccagcttggctccccagaacaacagctggccttcgagtggaaccagtctggacgaacagtcgatagaaccctttttcatggagagacaaacagcaaagtcgctggtgagcaccttggaaatggtcataagagcgaagagaggaaaggcgaacaggtgttgaaatcggtgatgaggctgccaagcagtgtcgggatgcattcgcatgagaggatagctggaaaacacatctgggtcgttctcgggaaggctgaacagcgtatcggaaacgagattcgtgtactgatggtgtccaatgacatgctggtactcccacacggtggacgaggcaccgatcaagtccatgccccatcctgcgagtctgttgaccagggtggatcgagagaaagcaccgtggttgccatcgtgttgaatgctcagtccgacatgcgaaccggcaaagccccagacggcagcccacaggaaagacttgtgggcaacccacatgtaccaggagacaaagaagagggtaagcaccaggagagccttgactcccagtccacctcgacgtgcctgtccagcctccttgagtcgtgcaagagcccgtcgtttgagctcagggtaaaagtccgattctccccaagcgtagaaagtcttgggatcctggagtgtgccgatacggtacttctccatgaccttgtctggtcgtccagcgggatggtaggactcgaccagaatggtgcagtctcgaccaagtccgagagtgatgacgccacctccaggatgcttggccaggaaatcggtgacgtcgtacacaccttcgtgacaggtgagccatccatcggtgggaagaatgtgtcgtctgacctcgtctgtggtgaacagtcgctccttgccctgtcccgacacggcgagagagtcatagtaagttgcgggtggaagaccggcaggtctagc

SEQ ID NO: 402 - DNA, 13085 bp, Artificial Sequence
  Plasmid pZKL4-220Eg4-3
catggccattgctgtagatatgtcttgtgtgtaagggggttggggtggttgtttgtgttcttgacttttgtgttagcaagggaagacgggcaaaaaagtgagtgtggttgggagggagagacgagccttatatataatgcttgtttgtgtttgtgcaagtggacgccgaaacgggcaggagccaaactaaacaaggcagacaatgcgagcttaattggattgcctgatgggcaggggttagggctcgatcaatgggggtgcgaagtgacaaaattgggaattaggttcgcaagcaaggctgacaagactttggcccaaacatttgtacgcggtggacaacaggagccacccatcgtctgtcacgggctagccggtcgtgcgtcctgtcaggctccacctaggctccatgccactccatacaatcccactagtgtaccgctaggccgcttttagctcccatctaagacccccccaaaacctccactgtacagtgcactgtactgtgtggcgatcaagggcaagggaaaaaaggcgcaaacatgcacgcatggaatgacgtaggtaaggcgttactagactgaaaagtggcacatttcggcgtgccaaagggtcctaggtgcgtttcgcgagctgggcgccaggccaagccgctccaaaacgcctctccgactccctccagcggcctccatatccccatccctctccacagcaatgttgttaagccttgcaaacgaaaaaatagaaaggctaataagcttccaatattgtggtgtacgctgcataacgcaacaatgagcgccaaacaacacacacacacagcacacagcagcattaaccacgatgtttaaacagagtgtgaaagactcactatggtccgggcttatctcgaccaatagccaaagtctggagtttctgagagaaaaaggcaagatacgtatgtaacaaagcgacgcatggtacaataataccggaggcatgtatcatagagagttagtggttcgatgatggcactggtgcctggtatgactttatacggctgactacatatttgtcctcagacatacaattacagtcaagcacttacccttggacatctgtaggtaccccccggccaagacgatctcagcgtgtcgtatgtcggattggcgtagctccctcgctcgtcaattggctcccatctactttcttctgcttggctacacccagcatgtctgctatggctcgttttcgtgccttatctatcctcccagtattaccaactctaaatgacatgatgtgattgggtctacactttcatatcagagataaggagtagcacagttgcataaaaagcccaactctaatcagcttcttcctttcttgtaattagtacaaaggtgattagcgaaatctggaagcttagttggccctaaaaaaatcaaaaaaagcaaaaaacgaaaaacgaaaaaccacagttttgagaacagggaggtaacgaaggatcgtatatatatatatatatatatatacccacggatcccgagaccggcctttgattcttccctacaaccaaccattctcaccaccctaattcacaaccatggctgactctcccgtcatcaacctctccaccatgtggaagcctctgtcgctcatggccttggatcttgctgttctgggacacgtctggaagcaggcacaacaggagggctccatctcggcttacgccgactctgtgtggactcccctcatcatgtccggtctgtacctctccatgatcttcgtgggatgtcgatggatgaagaaccgagagcccttcgaaatcaagacctacatgtttgcctacaacctgtaccagaccctcatgaacctttgcattgtgctgggcttcctctaccaggtccacgctaccggtatgcgattctggggatctggcgtggaccgatcgcccaagggtctgggaattggctttttcatctatgcccattaccacaacaagtacgtcgagtacttcgacacactcttcatggtgctgcggaaaaagaacaaccagatttcctttcttcacgtctaccatcacgctctgctcacctgggcttggtttgccgtggtctacttcgctcctggaggtgacggctggtttggagcctgctacaattcctccattcatgtcctgatgtactcttactatctgcttgccaccttcggcatctcctgtccctggaaaaagatcctcacccagctgcaaatggttcagttctgcttttgcttcacccactcgatctacgtgtggatttgcggttccgaaatctaccctcgacccttgactgctctccagtccttcgtgatggtcaacatgctggttctctttggcaacttctacgtcaagcagtattctcagaagaatggaaagcccgagaacggtgccactcctgagaacggtgccaagcctcagccctgcgagaacggcaccgtcgagaagcgagagaacgacactgccaacgttcgataagcggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaactccgagccgtgagtatccacgacaagatcagtgtcgagacgacgcgttttgtgtaatgacacaatccgaaagtcgctagcaacacacactctctacacaaactaacccagctctggtaccatggccgagggcaagtccgacggtcccgtcgttaccctccagtccatgtggaagcccctggctctcatggccatcgacgtcggcatcctggtcaacgtgcgacggaaggccttcaccgagttcgacggacactcgaacgtcttcgccgatcccgtgtacattccctttgtcatgaacctgttctacctcaccatgatctttgctggctgccgatggatgaagactcgagaacccttcgagatcaagtcctacatgtttgcctacaacgcttaccagacaatgatgaactttctcattgtggtcggcttcatgtatgaggttcactccaccggtatgcgatactggggatccagaatcgacacttctaccaagggcttgggactgggtttcctcatctatgcccattaccacaacaagtacgtggagtacgtcgacaccctgttcatgattctgcggaagaaaaacaatcagatctcgttccttcacgtttaccaccattccctgctcacttgggcatggtgggctgtggtctactgggctcctggcggagatgcctggttcggtgcctgttacaactccttcatccacgttctcatgtactcctactatctgtttgccaccttcggcattcgatgtccctggaaaaagatgctcacccagttgcaaatggtccagttctgcttttgcttcgctcatgccatgtacgttggatggcttggtcacgaggtgtaccctcgatggctcactgctctgcaggcctttgtgatgctcaacatgctggtcctctttggcaacttctacatgaagtcttactccaaggcgagcaagctcgaaccagcctctcccgtgtcgcctgcctctcttgctcagaagcccttcgagaacgccaaggtcaagtaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgtagggatcaggtgcttaggaagctcgaccaaccacggagactgttgaaactggatgtcggtaacagcatctggaatgctgaatgttcctcgaataacaacatatttctccttgttgaggtgatcataagctatgtatccggtgattgaagtggaatagaagtctcctccgaagactgagtccaacgtcatgttcgggaaataccgacaactctctccacatgtaaaatcagttcgtagaggagtgactggcgcattgacacagtaggcgatgtttgcaatccgagaaaacttggccgtaaagttgtacagctcctgggaggcttgaactcgagtttttgaaagtgtcgctggtggctcgccgaagagggaggcatagaggtacgcaaccacttgcccgagcgtgaggttcatgatgccaatagtgaatgtcatttatcaccgtactgcgcagtatttatatagggctcatcggtccatgtatagatctgtccacttatgacacccccatgtctcattaatgtgtaaaggtggagacgggtggagtacaggtacagagttggaggaaatcaggatagtggggttaagacatgctccgagtccaaatttcaactctccattgtcacaagacctctggtttcagagttattacagatctaggcctgtttcaaggtgaggggacctcatctggatcggcacgacgatcgtcaccttacagaggacgtctgtcgcagggaaaggtgatgtggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgccaaggcgtatattagttggtgggaaccagtgtacgaccgggtcctgtataaccaggttcagtggcatacttgtaggagttgttcccgtggtatttgggcatggctaagacatttcgccgaccaatgttaagtgcacaatagccgatgtagtagatgtaagccagatggttttggagcaggtcgattcgagaccacagattgaaagtgcctcgatggcaggcctcgttttctcctccttcacagacagacactttgtcgagtgcagggtagacgctttcttggtcaatgtacacttctccaatggcgtgtgtgtaattggaccaatctggcagtccaacgaagatatcgttccagtgggtgagcctgtagtttcgtcgcttgtcgtttacttcaaggcctgtgtcattaaaccacagctggttgatgtagtttgcaaactctgagtttcctactctcggctggccaaagttgatcatggtaggatcatgtccaagtaatttgaagtgagttgcgaaaagaagagcttgagcagcgcccagcgagtgaccagtaacatacattttgtagtcagtgtggttggtgaggaacttttcaaactgaggagcagcattgaccatagtttcgttgaaggccttggcgaacccatcatggatcatgcagcctttgcactcactagttttgatgggaataagacgggggtcttcaaccaccagagcccgctctttgaggttgtcaagacctttgttctccacttccaagtctggtcggactgcccatctctgttaattaagttgcgacacatgtcttgatagtatcttgaattctctctcttgagcttttccataacaagttcttctgcctccaggaagtccatgggtggtttgatcatggttttggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgaccttttccttgggaaccaccaccgtcagcccttctgactcacgtattgtagccaccgacacaggcaacagtccgtggatagcagaatatgtcttgtcggtccatttctcaccaactttaggcgtcaagtgaatgttgcagaagaagtatgtgccttcattgagaatcggtgttgctgatttcaataaagtcttgagatcagtttggccagtcatgttgtggggggtaattggattgagttatcgcctacagtctgtacaggtatactcgctgcccactttatactttttgattccgctgcacttgaagcaatgtcgtttaccaaaagtgagaatgctccacagaacacaccccagggtatggttgagcaaaaaataaacactccgatacggggaatcgaaccccggtctccacggttctcaagaagtattcttgatgagagcgtatcgatcgaggaagaggacaagcggctgcttcttaagtttgtgacatcagtatccaaggcaccattgcaaggattcaaggctttgaacccgtcatttgccattcgtaacgctggtagacaggttgatcggttccctacggcctccacctgtgtcaatcttctcaagctgcctgactatcaggacattgatcaacttcggaagaaacttttgtatgccattcgatcacatgctggtttcgatttgtcttagaggaacgcatatacagtaatcatagagaataaacgatattcatttattaaagtagatagttgaggtagaagttgtaaagagtgataaatagcggccgcttaggactttttgtcgccgttggtaggcacgggaggagcacccatgagtcgcagatgctgaaccatgccacacacggcatcccagaacgtaacgtagttcttgtagggcaatccgtattcctcgcacacttccttgacaactcgagcaatgatgggatagttcgcgtgagagatgctgggaaacagatggtgctcgatctgatggttgaggccaccggagaggtgattggccagcacgcctccagatcgccagttgacacagcactggacttgtgtcacagcccaatcgttgggtggaggagtgggcttgacctttttcgcctcggctgcctgatgagctgcctggagcatctcggtccgtcgggcagcagtttgaaaggaggtattcataaattcgcaagactcggagatgtggttaatgatgaaacagatggccaggtactctccagacacaaggtgggcaacagagaacagagcaaggcccatagcagttccgtggaggtagcagggcagcacaatctgcaagagaaagttcgccagcttggctccccagaacaacagctggccttcgagtggaaccagtctggacgaacagtcgatagaaccctttttcatggagagacaaacagcaaagtcgctggtgagcaccttggaaatggtcataagagcgaagagaggaaaggcgaacaggtgttgaaatcggtgatgaggctgccaagcagtgtcgggatgcattcgcatgagaggatagctggaaaacacatctgggtcgttctcgggaaggctgaacagcgtatcggaaacgagattcgtgtactgatggtgtccaatgacatgctggtactcccacacggtggacgaggcaccgatcaagtccatgccccatcctgcgagtctgttgaccagggtggatcgagagaaagcaccgtggttgccatcgtgttgaatgctcagtccgacatgcgaaccggcaaagccccagacggcagcccacaggaaagacttgtgggcaacccacatgtaccaggagacaaagaagagggtaagcaccaggagagccttgactcccagtccacctcgacgtgcctgtccagcctccttgagtcgtgcaagagcccgtcgtttgagctcagggtaaaagtccgattctccccaagcgtagaaagtcttgggatcctggagtgtgccgatacggtacttctccatgaccttgtctggtcgtccagcgggatggtaggactcgaccagaatggtgcagtctcgaccaagtccgagagtgatgacgccacctccaggatgcttggccaggaaatcggtgacgtcgtacacaccttcgtgacaggtgagccatccatcggtgggaagaatgtgtcgtctgacctcgtctgtggtgaacagtcgctccttgccctgtcccgacac

SEQ ID NO: 403 - DNA, 1542 bp, Euglena gracilis
  CDS (1)..(1542): synthetic truncated delta-4 desaturase (codon-optimized for Yarrowia lipolytica)
atggccaaaccgcaaccttgcgagaacggtaccgtggagaagcgagaaaacgacaccgccaatgttcgacccgctagacctgccggtcttccacccgcaacttactatgactctctcgccgtgtcgggacagggcaaggagcgactgttcaccacagacgaggtcagacgacacattcttcccaccgatggatggctcacctgtcacgaaggtgtgtacgacgtcaccgatttcctggccaagcatcctggaggtggcgtcatcactctcggacttggtcgagactgcaccattctggtcgagtcctaccatcccgctggacgaccagacaaggtcatggagaagtaccgtatcggcacactccaggatcccaagactttctacgcttggggagaatcggacttttaccctgagctcaaacgacgggctcttgcacgactcaaggaggctggacaggcacgtcgaggtggactgggagtcaaggctctcctggtgcttaccctcttctttgtctcctggtacatgtgggttgcccacaagtctttcctgtgggctgccgtctggggctttgccggttcgcatgtcggactgagcattcaacacgatggcaaccacggtgctttctctcgatccaccctggtcaacagactcgcaggatggggcatggacttgatcggtgcctcgtccaccgtgtgggagtaccagcatgtcattggacaccatcagtacacgaatctcgtttccgatacgctgttcagccttcccgagaacgacccagatgtgttttccagctatcctctcatgcgaatgcatcccgacactgcttggcagcctcatcaccgatttcaacacctgttcgcctttcctctcttcgctcttatgaccatttccaaggtgctcaccagcgactttgctgtttgtctctccatgaaaaagggttctatcgactgttcgtccagactggttccactcgaaggccagctgttgttctggggagccaagctggcgaactttctcttgcagattgtgctgccctgctacctccacggaactgctatgggccttgctctgttctctgttgcccaccttgtgtctggagagtacctggccatctgtttcatcattaaccacatctccgagtcttgcgaatttatgaatacctcctttcaaactgctgcccgacggaccgagatgctccaggcagctcatcaggcagccgaggcgaaaaaggtcaagcccactcctccacccaacgattgggctgtgacacaagtccagtgctgtgtcaactggcgatctggaggcgtgctggccaatcacctctccggtggcctcaaccatcagatcgagcaccatctgtttcccagcatctctcacgcgaactatcccatcattgctcgagttgtcaaggaagtgtgcgaggaatacggattgccctacaagaactacgttacgttctgggatgccgtgtgtggcatggttcagcatctgcgactcatgggtgctcctcccgtgcctaccaacggcgacaaaaagtcctaa

SEQ ID NO: 404 - protein, 513 aa, Euglena gracilis
MAKPQPCENGTVEKRENDTANVRPARPAGLPPATYYDSLAVSGQGKERLFTTDEVRRHILPTDGWLTCHEGVYDVTDFLAKHPGGGVITLGLGRDCTILVESYHPAGRPDKVMEKYRIGTLQDPKTFYAWGESDFYPELKRRALARLKEAGQARRGGLGVKALLVLTLFFVSWYMWVAHKSFLWAAVWGFAGSHVGLSIQHDGNHGAFSRSTLVNRLAGWGMDLIGASSTVWEYQHVIGHHQYTNLVSDTLFSLPENDPDVFSSYPLMRMHPDTAWQPHHRFQHLFAFPLFALMTISKVLTSDFAVCLSMKKGSIDCSSRLVPLEGQLLFWGAKLANFLLQIVLPCYLHGTAMGLALFSVAHLVSGEYLAICFIINHISESCEFMNTSFQTAARRTEMLQAAHQAAEAKKVKPTPPPNDWAVTQVQCCVNWRSGGVLANHLSGGLNHQIEHHLFPSISHANYPIIARVVKEVCEEYGLPYKNYVTFWDAVCGMVQHLRLMGAPPVPTNGDKKS

SEQ ID NO: 405 - DNA, 1473 bp, Euglena gracilis
  CDS (1)..(1473): synthetic truncated delta-4 desaturase (codon-optimized for Yarrowia lipolytica)
atggctagacctgccggtcttccacccgcaacttactatgactctctcgccgtgtcgggacagggcaaggagcgactgttcaccacagacgaggtcagacgacacattcttcccaccgatggatggctcacctgtcacgaaggtgtgtacgacgtcaccgatttcctggccaagcatcctggaggtggcgtcatcactctcggacttggtcgagactgcaccattctggtcgagtcctaccatcccgctggacgaccagacaaggtcatggagaagtaccgtatcggcacactccaggatcccaagactttctacgcttggggagaatcggacttttaccctgagctcaaacgacgggctcttgcacgactcaaggaggctggacaggcacgtcgaggtggactgggagtcaaggctctcctggtgcttaccctcttctttgtctcctggtacatgtgggttgcccacaagtctttcctgtgggctgccgtctggggctttgccggttcgcatgtcggactgagcattcaacacgatggcaaccacggtgctttctctcgatccaccctggtcaacagactcgcaggatggggcatggacttgatcggtgcctcgtccaccgtgtgggagtaccagcatgtcattggacaccatcagtacacgaatctcgtttccgatacgctgttcagccttcccgagaacgacccagatgtgttttccagctatcctctcatgcgaatgcatcccgacactgcttggcagcctcatcaccgatttcaacacctgttcgcctttcctctcttcgctcttatgaccatttccaaggtgctcaccagcgactttgctgtttgtctctccatgaaaaagggttctatcgactgttcgtccagactggttccactcgaaggccagctgttgttctggggagccaagctggcgaactttctcttgcagattgtgctgccctgctacctccacggaactgctatgggccttgctctgttctctgttgcccaccttgtgtctggagagtacctggccatctgtttcatcattaaccacatctccgagtcttgcgaatttatgaatacctcctttcaaactgctgcccgacggaccgagatgctccaggcagctcatcaggcagccgaggcgaaaaaggtcaagcccactcctccacccaacgattgggctgtgacacaagtccagtgctgtgtcaactggcgatctggaggcgtgctggccaatcacctctccggtggcctcaaccatcagatcgagcaccatctgtttcccagcatctctcacgcgaactatcccatcattgctcgagttgtcaaggaagtgtgcgaggaatacggattgccctacaagaactacgttacgttctgggatgccgtgtgtggcatggttcagcatctgcgactcatgggtgctcctcccgtgcctaccaacggcgacaaaaagtcctaa

SEQ ID NO: 406 - protein, 490 aa, Euglena gracilis
MARPAGLPPATYYDSLAVSGQGKERLFTTDEVRRHILPTDGWLTCHEGVYDVTDFLAKHPGGGVITLGLGRDCTILVESYHPAGRPDKVMEKYRIGTLQDPKTFYAWGESDFYPELKRRALARLKEAGQARRGGLGVKALLVLTLFFVSWYMWVAHKSFLWAAVWGFAGSHVGLSIQHDGNHGAFSRSTLVNRLAGWGMDLIGASSTVWEYQHVIGHHQYTNLVSDTLFSLPENDPDVFSSYPLMRMHPDTAWQPHHRFQHLFAFPLFALMTISKVLTSDFAVCLSMKKGSIDCSSRLVPLEGQLLFWGAKLANFLLQIVLPCYLHGTAMGLALFSVAHLVSGEYLAICFIINHISESCEFMNTSFQTAARRTEMLQAAHQAAEAKKVKPTPPPNDWAVTQVQCCVNWRSGGVLANHLSGGLNHQIEHHLFPSISHANYPIIARVVKEVCEEYGLPYKNYVTFWDAVCGMVQHLRLMGAPPVPTNGDKKS

SEQ ID NO: 407 - DNA, 1425 bp, Euglena gracilis
  CDS (1)..(1425): synthetic truncated delta-4 desaturase (codon-optimized for Yarrowia lipolytica)
atggtgtcgggacagggcaaggagcgactgttcaccacagacgaggtcagacgacacattcttcccaccgatggatggctcacctgtcacgaaggtgtgtacgacgtcaccgatttcctggccaagcatcctggaggtggcgtcatcactctcggacttggtcgagactgcaccattctggtcgagtcctaccatcccgctggacgaccagacaaggtcatggagaagtaccgtatcggcacactccaggatcccaagactttctacgcttggggagaatcggacttttaccctgagctcaaacgacgggctcttgcacgactcaaggaggctggacaggcacgtcgaggtggactgggagtcaaggctctcctggtgcttaccctcttctttgtctcctggtacatgtgggttgcccacaagtctttcctgtgggctgccgtctggggctttgccggttcgcatgtcggactgagcattcaacacgatggcaaccacggtgctttctctcgatccaccctggtcaacagactcgcaggatggggcatggacttgatcggtgcctcgtccaccgtgtgggagtaccagcatgtcattggacaccatcagtacacgaatctcgtttccgatacgctgttcagccttcccgagaacgacccagatgtgttttccagctatcctctcatgcgaatgcatcccgacactgcttggcagcctcatcaccgatttcaacacctgttcgcctttcctctcttcgctcttatgaccatttccaaggtgctcaccagcgactttgctgtttgtctctccatgaaaaagggttctatcgactgttcgtccagactggttccactcgaaggccagctgttgttctggggagccaagctggcgaactttctcttgcagattgtgctgccctgctacctccacggaactgctatgggccttgctctgttctctgttgcccaccttgtgtctggagagtacctggccatctgtttcatcattaaccacatctccgagtcttgcgaatttatgaatacctcctttcaaactgctgcccgacggaccgagatgctccaggcagctcatcaggcagccgaggcgaaaaaggtcaagcccactcctccacccaacgattgggctgtgacacaagtccagtgctgtgtcaactggcgatctggaggcgtgctggccaatcacctctccggtggcctcaaccatcagatcgagcaccatctgtttcccagcatctctcacgcgaactatcccatcattgctcgagttgtcaaggaagtgtgcgaggaatacggattgccctacaagaactacgttacgttctgggatgccgtgtgtggcatggttcagcatctgcgactcatgggtgctcctcccgtgcctaccaacggcgacaaaaagtcctaa

SEQ ID NO: 408 - protein, 474 aa, Euglena gracilis
MVSGQGKERLFTTDEVRRHILPTDGWLTCHEGVYDVTDFLAKHPGGGVITLGLGRDCTILVESYHPAGRPDKVMEKYRIGTLQDPKTFYAWGESDFYPELKRRALARLKEAGQARRGGLGVKALLVLTLFFVSWYMWVAHKSFLWAAVWGFAGSHVGLSIQHDGNHGAFSRSTLVNRLAGWGMDLIGASSTVWEYQHVIGHHQYTNLVSDTLFSLPENDPDVFSSYPLMRMHPDTAWQPHHRFQHLFAFPLFALMTISKVLTSDFAVCLSMKKGSIDCSSRLVPLEGQLLFWGAKLANFLLQIVLPCYLHGTAMGLALFSVAHLVSGEYLAICFIINHISESCEFMNTSFQTAARRTEMLQAAHQAAEAKKVKPTPPPNDWAVTQVQCCVNWRSGGVLANHLSGGLNHQIEHHLFPSISHANYPIIARVVKEVCEEYGLPYKNYVTFWDAVCGMVQHLRLMGAPPVPTNGDKKS

SEQ ID NO: 409 - DNA, 10417 bp, Artificial Sequence
  Plasmid pZKLY-G204
ggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaatttaaatgtaacgaaactgaaatttgaccagatattgtgtccgcggtggagctccagcttttgttccctttagtgagggttaatttcgagcttggcgtaatcatggtcatagctgtttcctgtgtgaaattgttatccgctcacaagcttccacacaacgtacgttgattgaggtggagccagatgggctattgtttcatatatagactggcagccacctctttggcccagcatgtttgtatacctggaagggaaaactaaagaagctggctagtttagtttgattattatagtagatgtcctaatcactagagattagaatgtcttggcgatgattagtcgtcgtcccctgtatcatgtctagaccaactgtgtcatgaagttggtgctggtgttttacctgtgtactacaagtaggtgtcctagatctagtgtacagagccgtttagacccatgtggacttcaccattaacgatggaaaatgttcattatatgacagtatattacaatggacttgctccatttcttccttgcatcacatgttctccacctccatagttgatcaacacatcatagtagctaaggctgctgctctcccactacagtccaccacaagttaagtagcaccgtcagtacagctaaaagtacacgtctagtacgtttcataactagtcaagtagcccctattacagatatcagcactatcacgcacgagtttttctctgtgctatctaatcaacttgccaagtattcggagaagatacactttcttggcatcaggtatacgagggagcctatcagatgaaaaagggtatattggatccattcatatccacctacacgttgtcataatctcctcattcacgtgattcatttcgtgacactagtttctcactttcccccccgcacctatagtcaacttggcggacacgctacttgtagctgacgttgatttatagacccaatcaaagcgggttatcggtcaggtagcacttatcattcatcgttcatactacgatgagcaatctcgggcatgtccggaaaagtgtcgggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcattccgacagcagcgactgggcaccatgatcaagcgaaacaccttcccccagctgccctggcaaaccatcaagaaccctactttcatcaagtgcaagaacggttctactcttctcacctccggtgtctacggctggtgccgaaagcctaactacaccgctgatttcatcatgtgcctcacctgggctctcatgtgcggtgttgcttctcccctgccttacttctacccggtcttcttcttcctggtgctcatccaccgagcttaccgagactttgagcgactggagcgaaagtacggtgaggactaccaggagttcaagcgacaggtcccttggatcttcatcccttatgttttctaaacgataagcttagtgagcgaatggtgaggttacttaattgagtggccagcctatgggattgtataacagacagtcaatatattactgaaaagactgaacagccagacggagtgaggttgtgagtgaatcgtagagggcggctattacagcaagtctactctacagtgtactaacacagcagagaacaaatacaggtgtgcattcggctatctgagaattagttggagagctcgagaccctcggcgataaactgctcctcggttttgtgtccatacttgtacggaccattgtaatggggcaagtcgttgagttctcgtcgtccgacgttcagagcacagaaaccaatgtaatcaatgtagcagagatggttctgcaaaagattgatttgtgcgagcaggttaattaagttgcgacacatgtcttgatagtatcttgaattctctctcttgagcttttccataacaagttcttctgcctccaggaagtccatgggtggtttgatcatggttttggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgaccttttccttgggaaccaccaccgtcagcccttctgactcacgtattgtagccaccgacacaggcaacagtccgtggatagcagaatatgtcttgtcggtccatttctcaccaactttaggcgtcaagtgaatgttgcagaagaagtatgtgccttcattgagaatcggtgttgctgatttcaataaagtcttgagatcagtttggccagtcatgttgtggggggtaattggattgagttatcgcctacagtctgtacaggtatactcgctgcccactttatactttttgattccgctgcacttgaagcaatgtcgtttaccaaaagtgagaatgctccacagaacacaccccagggtatggttgagcaaaaaataaacactccgatacggggaatcgaaccccggtctccacggttctcaagaagtattcttgatgagagcgtatcgatgagcctaaaatgaacccgagtatatctcataaaattctcggtgagaggtctgtgactgtcagtacaaggtgccttcattatgccctcaaccttaccatacctcactgaatgtagtgtacctctaaaaatgaaatacagtgccaaaagccaaggcactgagctcgtctaacggacttgatatacaaccaattaaaacaaatgaaaagaaatacagttctttgtatcatttgtaacaattaccctgtacaaactaaggtattgaaatcccacaatattcccaaagtccacccctttccaaattgtcatgcctacaactcatataccaagcactaacctaccgtttaaacagagtgtgaaagactcactatggtccgggcttatctcgaccaatagccaaagtctggagtttctgagagaaaaaggcaagatacgtatgtaacaaagcgacgcatggtacaataataccggaggcatgtatcatagagagttagtggttcgatgatggcactggtgcctggtatgactttatacggctgactacatatttgtcctcagacatacaattacagtcaagcacttacccttggacatctgtaggtaccccccggccaagacgatctcagcgtgtcgtatgtcggattggcgtagctccctcgctcgtcaattggctcccatctactttcttctgcttggctacacccagcatgtctgctatggctcgttttcgtgccttatctatcctcccagtattaccaactctaaatgacatgatgtgattgggtctacactttcatatcagagataaggagtagcacagttgcataaaaagcccaactctaatcagcttcttcctttcttgtaattagtacaaaggtgattagcgaaatctggaagcttagttggccctaaaaaaatcaaaaaaagcaaaaaacgaaaaacgaaaaaccacagttttgagaacagggaggtaacgaaggatcgtatatatatatatatatatatatacccacggatcccgagaccggcctttgattcttccctacaaccaaccattctcaccaccctaattcacaaccatggctgactctcccgtcatcaacctctccaccatgtggaagcctctgtcgctcatggccttggatcttgctgttctgggacacgtctggaagcaggcacaacaggagggctccatctcggcttacgccgactctgtgtggactcccctcatcatgtccggtctgtacctctccatgatcttcgtgggatgtcgatggatgaagaaccgagagcccttcgaaatcaagacctacatgtttgcctacaacctgtaccagaccctcatgaacctttgcattgtgctgggcttcctctaccaggtccacgctaccggtatgcgattctggggatctggcgtggaccgatcgcccaagggtctgggaattggctttttcatctatgcccattaccacaacaagtacgtcgagtacttcgacacactcttcatggtgctgcggaaaaagaacaaccagatttcctttcttcacgtctaccatcacgctctgctcacctgggcttggtttgccgtggtctacttcgctcctggaggtgacggctggtttggagcctgctacaattcctccattcatgtcctgatgtactcttactatctgcttgccaccttcggcatctcctgtccctggaaaaagatcctcacccagctgcaaatggttcagttctgcttttgcttcacccactcgatctacgtgtggatttgcggttccgaaatctaccctcgacccttgactgctctccagtccttcgtgatggtcaacatgctggttctctttggcaacttctacgtcaagcagtattctcagaagaatggaaagcccgagaacggtgccactcctgagaacggtgccaagcctcagccctgcgagaacggtaccgtggagaagcgagaaaacgacaccgccaatgttcgacccgctagacctgccggtcttccacccgcaacttactatgactctctcgccgtgtcgggacagggcaaggagcgactgttcaccacagacgaggtcagacgacacattcttcccaccgatggatggctcacctgtcacgaaggtgtgtacgacgtcaccgatttcctggccaagcatcctggaggtggcgtcatcactctcggacttggtcgagactgcaccattctggtcgagtcctaccatcccgctggacgaccagacaaggtcatggagaagtaccgtatcggcacactccaggatcccaagactttctacgcttggggagaatcggacttttaccctgagctcaaacgacgggctcttgcacgactcaaggaggctggacaggcacgtcgaggtggactgggagtcaaggctctcctggtgcttaccctcttctttgtctcctggtacatgtgggttgcccacaagtctttcctgtgggctgccgtctggggctttgccggttcgcatgtcggactgagcattcaacacgatggcaaccacggtgctttctctcgatccaccctggtcaacagactcgcaggatggggcatggacttgatcggtgcctcgtccaccgtgtgggagtaccagcatgtcattggacaccatcagtacacgaatctcgtttccgatacgctgttcagccttcccgagaacgacccagatgtgttttccagctatcctctcatgcgaatgcatcccgacactgcttggcagcctcatcaccgatttcaacacctgttcgcctttcctctcttcgctcttatgaccatttccaaggtgctcaccagcgactttgctgtttgtctctccatgaaaaagggttctatcgactgttcgtccagactggttccactcgaaggccagctgttgttctggggagccaagctggcgaactttctcttgcagattgtgctgccctgctacctccacggaactgctatgggccttgctctgttctctgttgcccaccttgtgtctggagagtacctggccatctgtttcatcattaaccacatctccgagtcttgcgaatttatgaatacctcctttcaaactgctgcccgacggaccgagatgctccaggcagctcatcaggcagccgaggcgaaaaaggtcaagcccactcctccacccaacgattgggctgtgacacaagtccagtgctgtgtcaactggcgatctggaggcgtgctggccaatcacctctccggtggcctcaaccatcagatcgagcaccatctgtttcccagcatctctcacgcgaactatcccatcattgctcgagttgtcaaggaagtgtgcgaggaatacggattgccctacaagaactacgttacgttctgggatgccgtgtgtggcatggttcagcatctgcgactcatgggtgctcctcccgtgcctaccaacggcgacaaaaagtcctaagc

SEQ ID NO: 410 - DNA, 2382 bp, Euglena gracilis
  CDS (1)..(2382): synthetic DHA synthase (codon-optimized for Yarrowia lipolytica)
atggctgactctcccgtcatcaacctctccaccatgtggaagcctctgtcgctcatggccttggatcttgctgttctgggacacgtctggaagcaggcacaacaggagggctccatctcggcttacgccgactctgtgtggactcccctcatcatgtccggtctgtacctctccatgatcttcgtgggatgtcgatggatgaagaaccgagagcccttcgaaatcaagacctacatgtttgcctacaacctgtaccagaccctcatgaacctttgcattgtgctgggcttcctctaccaggtccacgctaccggtatgcgattctggggatctggcgtggaccgatcgcccaagggtctgggaattggctttttcatctatgcccattaccacaacaagtacgtcgagtacttcgacacactcttcatggtgctgcggaaaaagaacaaccagatttcctttcttcacgtctaccatcacgctctgctcacctgggcttggtttgccgtggtctacttcgctcctggaggtgacggctggtttggagcctgctacaattcctccattcatgtcctgatgtactcttactatctgcttgccaccttcggcatctcctgtccctggaaaaagatcctcacccagctgcaaatggttcagttctgcttttgcttcacccactcgatctacgtgtggatttgcggttccgaaatctaccctcgacccttgactgctctccagtccttcgtgatggtcaacatgctggttctctttggcaacttctacgtcaagcagtattctcagaagaatggaaagcccgagaacggtgccactcctgagaacggtgccaagcctcagccctgcgagaacggtaccgtggagaagcgagaaaacgacaccgccaatgttcgacccgctagacctgccggtcttccacccgcaacttactatgactctctcgccgtgtcgggacagggcaaggagcgactgttcaccacagacgaggtcagacgacacattcttcccaccgatggatggctcacctgtcacgaaggtgtgtacgacgtcaccgatttcctggccaagcatcctggaggtggcgtcatcactctcggacttggtcgagactgcaccattctggtcgagtcctaccatcccgctggacgaccagacaaggtcatggagaagtaccgtatcggcacactccaggatcccaagactttctacgcttggggagaatcggacttttaccctgagctcaaacgacgggctcttgcacgactcaaggaggctggacaggcacgtcgaggtggactgggagtcaaggctctcctggtgcttaccctcttctttgtctcctggtacatgtgggttgcccacaagtctttcctgtgggctgccgtctggggctttgccggttcgcatgtcggactgagcattcaacacgatggcaaccacggtgctttctctcgatccaccctggtcaacagactcgcaggatggggcatggacttgatcggtgcctcgtccaccgtgtgggagtaccagcatgtcattggacaccatcagtacacgaatctcgtttccgatacgctgttcagccttcccgagaacgacccagatgtgttttccagctatcctctcatgcgaatgcatcccgacactgcttggcagcctcatcaccgatttcaacacctgttcgcctttcctctcttcgctcttatgaccatttccaaggtgctcaccagcgactttgctgtttgtctctccatgaaaaagggttctatcgactgttcgtccagactggttccactcgaaggccagctgttgttctggggagccaagctggcgaactttctcttgcagattgtgctgccctgctacctccacggaactgctatgggccttgctctgttctctgttgcccaccttgtgtctggagagtacctggccatctgtttcatcattaaccacatctccgagtcttgcgaatttatgaatacctcctttcaaactgctgcccgacggaccgagatgctccaggcagctcatcaggcagccgaggcgaaaaaggtcaagcccactcctccacccaacgattgggctgtgacacaagtccagtgctgtgtcaactggcgatctggaggcgtgctggccaatcacctctccggtggcctcaaccatcagatcgagcaccatctgtttcccagcatctctcacgcgaactatcccatcattgctcgagttgtcaaggaagtgtgcgaggaatacggattgccctacaagaactacgttacgttctgggatgccgtgtgtggcatggttcagcatctgcgactcatgggtgctcctcccgtgcctaccaacggcgacaaaaagtcctaa

SEQ ID NO: 411 - protein, 793 aa, Euglena gracilis; identical to SEQ ID NO: 12

SEQ ID NO: 412 - DNA, 3632 bp, Artificial Sequence
  Plasmid pEgC20ES-K
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacctcgcgaatgcatctagatccatggctgactctcccgtcatcaacctctccaccatgtggaagcctctgtcgctcatggccttggatcttgctgttctgggacacgtctggaagcaggcacaacaggagggctccatctcggcttacgccgactctgtgtggactcccctcatcatgtccggtctgtacctctccatgatcttcgtgggatgtcgatggatgaagaaccgagagcccttcgaaatcaagacctacatgtttgcctacaacctgtaccagaccctcatgaacctttgcattgtgctgggcttcctctaccaggtccacgctaccggtatgcgattctggggatctggcgtggaccgatcgcccaagggtctgggaattggctttttcatctatgcccattaccacaacaagtacgtcgagtacttcgacacactcttcatggtgctgcggaaaaagaacaaccagatttcctttcttcacgtctaccatcacgctctgctcacctgggcttggtttgccgtggtctacttcgctcctggaggtgacggctggtttggagcctgctacaattcctccattcatgtcctgatgtactcttactatctgcttgccaccttcggcatctcctgtccctggaaaaagatcctcacccagctgcaaatggttcagttctgcttttgcttcacccactcgatctacgtgtggatttgcggttccgaaatctaccctcgacccttgactgctctccagtccttcgtgatggtcaacatgctggttctctttggcaacttctacgtcaagcagtattctcagaagaatggaaagcccgagaacggtgccactcctgagaacggtgccaagcctcagccctgcgagaacggtaccgtcgagaagcgagagaacgacactgccaacgttcgataagcggccgcatcggatcccgggcccgtcgactgcagaggcctgcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 413 - DNA, 35 bp, Artificial Sequence
  Primer YL973
cagccctgcgagaacggtaccgtcgagaagcgaga

SEQ ID NO: 414 - DNA, 35 bp, Artificial Sequence
  Primer YL974
tctcgcttctcgacggtaccgttctcgcagggctg

SEQ ID NO: 415 - DNA, 6652 bp, Artificial Sequence
  Plasmid pYNTGUS1-CNP
catggatggtacgtcctgtagaaaccccaacccgtgaaatcaaaaaactcgacggcctgtgggcattcagtctggatcgcgaaaactgtggaattgatcagcgttggtgggaaagcgcgttacaagaaagccgggcaattgctgtgccaggcagttttaacgatcagttcgccgatgcagatattcgtaattatgcgggcaacgtctggtatcagcgcgaagtctttataccgaaaggttgggcaggccagcgtatcgtgctgcgtttcgatgcggtcactcattacggcaaagtgtgggtcaataatcaggaagtgatggagcatcagggcggctatacgccatttgaagccgatgtcacgccgtatgttattgccgggaaaagtgtacgtatcaccgtttgtgtgaacaacgaactgaactggcagactatcccgccgggaatggtgattaccgacgaaaacggcaagaaaaagcagtcttacttccatgatttctttaactatgccgggatccatcgcagcgtaatgctctacaccacgccgaacacctgggtggacgatatcaccgtggtgacgcatgtcgcgcaagactgtaaccacgcgtctgttgactggcaggtggtggccaatggtgatgtcagcgttgaactgcgtgatgcggatcaacaggtggttgcaactggacaaggcactagcgggactttgcaagtggtgaatccgcacctctggcaaccgggtgaaggttatctctatgaactgtgcgtcacagccaaaagccagacagagtgtgatatctacccgcttcgcgtcggcatccggtcagtggcagtgaagggcgaacagttcctgattaaccacaaaccgttctactttactggctttggtcgtcatgaagatgcggacttacgtggcaaaggattcgataacgtgctgatggtgcacgaccacgcattaatggactggattggggccaactcctaccgtacctcgcattacccttacgctgaagagatgctcgactgggcagatgaacatggcatcgtggtgattgatgaaactgctgctgtcggctttaacctctctttaggcattggtttcgaagcgggcaacaagccgaaagaactgtacagcgaagaggcagtcaacggggaaactcagcaagcgcacttacaggcgattaaagagctgatagcgcgtgacaaaaaccacccaagcgtggtgatgtggagtattgccaacgaaccggatacccgtccgcaagtgcacgggaatatttcgccactggcggaagcaacgcgtaaactcgacccgacgcgtccgatcacctgcgtcaatgtaatgttctgcgacgctcacaccgataccatcagcgatctctttgatgtgctgtgcctgaaccgttattacggatggtatgtccaaagcggcgatttggaaacggcagagaaggtactggaaaaagaacttctggcctggcaggagaaactgcatcagccgattatcatcaccgaatacggcgtggatacgttagccgggctgcactcaatgtacaccgacatgtggagtgaagagtatcagtgtgcatggctggatatgtatcaccgcgtctttgatcgcgtcagcgccgtcgtcggtgaacaggtatggaatttcgccgattttgcgacctcgcaaggcatattgcgcgttggcggtaacaagaaagggatcttcactcgcgaccgcaaaccgaagtcggcggcttttctgctgcaaaaacgctggactggcatgaacttcggtgaaaaaccgcagcagggaggcaaacaatgattaattaactagagcggccgccaccgcggcccgagattccggcctcttcggccgccaagcgacccgggtggacgtctagaggtacctagcaattaacagatagtttgccggtgataattctcttaacctcccacactcctttgacataacgatttatgtaacgaaactgaaatttgaccagatattgtgtccgcggtggagctccagcttttgttccctttagtgagggttaatttcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcgtccttgaggactcgagtgacagtctttcgccaaagtcgagaggaggccagcacgttggccttgtcaagagaccacacgggaagaggggggttgtgctgaagggccaggaaggcggccattcgggcaattcgctcaacctcaggaacggagtaggtctcggtgtcggaagcgacgccagatccgtcatcctcctttcgctctccaaagtagatacctccgacgagctctcggacaatgatgaagtcggtgccctcaacgtttcggatgggggagagatcggcgagcttgggcgacagcagctggcagggtcgcaggttggcgtacaggttcaggtcctttcgcagcttgaggagaccctgctcgggtcgcacgtcggttcgtccgtcgggagtggtccatacggtgttggcagcgcctccgacagcaccgagcataatagagtcagcctttcggcagatgtcgagagtagcgtcggtgatgggctcgccctccttctcaatggcagctcctccaatgagtcggtcctcaaacacaaactcggtgccggaggcctcagcaacagacttgagcaccttgacggcctcggcaatcacctcggggccacagaagtcgccgccgagaagaacaatcttcttggagtcagtcttggtcttcttagtttcgggttccattgtggatgtgtgtggttgtatgtgtgatgtggtgtgtggagtgaaaatctgtggctggcaaacgctcttgtatatatacgcacttttgcccgtgctatgtggaagactaaacctccgaagattgtgactcaggtagtgcggtatcggctagggacccaaaccttgtcgatgccgatagcgctatcgaacgtaccccagccggccgggagtatgtcggaggggacatacgagatcgtcaagggtttgtggccaactggtaaataaatgatgtcgacataagtttgcaaaaagatcgtatcgatagttggagcaagggagaaatgtttaaacagagtgtgaaagactcactatggtccgggcttatctcgaccaatagccaaagtctggagtttctgagagaaaaaggcaagatacgtatgtaacaaagcgacgcatggtacaataataccggaggcatgtatcatagagagttagtggttcgatgatggcactggtgcctggtatgactttatacggctgactacatatttgtcctcagacatacaattacagtcaagcacttacccttggacatctgtaggtaccccccggccaagacgatctcagcgtgtcgtatgtcggattggcgtagctccctcgctcgtcaattggctcccatctactttcttctgcttggctacacccagcatgtctgctatggctcgttttcgtgccttatctatcctcccagtattaccaactctaaatgacatgatgtgattgggtctacactttcatatcagagataaggagtagcacagttgcataaaaagcccaactctaatcagcttcttcctttcttgtaattagtacaaaggtgattagcgaaatctggaagcttagttggccctaaaaaaatcaaaaaaagcaaaaaacgaaaaacgaaaaaccacagttttgagaacagggaggtaacgaaggatcgtatatatatatatatatatatatacccacggatcccgagaccggcctttgattcttccctacaaccaaccattctcaccaccctaattcacaac

SEQ ID NO: 416 - DNA, 9045 bp, Artificial Sequence
  Plasmid pZKLY
catggccacccgacagcgaactgctaccactgtcgtggtcgaggacctgcccaaggttaccctcgaggccaagtccgaacctgtctttcccgacatcaagaccatcaaggatgccattcctgctcactgctttcagccctctctggtcacctccttctactatgtgttccgagactttgctatggtttctgccctcgtctgggctgcccttacctacattccctcgatccctgatcagactctgcgagtggcagcttggatggtctacggcttcgttcagggactcttctgtaccggtgtctggattctcggacacgagtgcggtcatggagccttctctctgcacggcaaggtcaacaatgtcaccggatggtttcttcattccttcctgctcgttccctacttcagctggaagtactctcatcaccgacatcaccgattcacaggtcacatggatctggacatggctttcgttcccaagaccgagcccaaaccctccaagtctctcatgattgctggcattgacgttgccgaacttgtcgaggacactcctgctgcccagatggtcaagctcatcttccatcagctgttcggatggcaggcgtacctcttcttcaacgccagctctggcaagggttccaagcagtgggagcccaagactggactctcgaagtggtttcgagtgtctcacttcgagcctaccagcgctgtcttcagacccaacgaggccatcttcattctcatctcggacatcggtcttgctctcatgggcactgcactgtactttgcttccaagcaagtcggagtttctaccattctgttcctctaccttgttccctacctgtgggtccatcactggctcgtggccattacttaccttcaccatcaccataccgaactgcctcactacaccgctgagggctggacctacgtcaagggtgcactcgccactgtggatcgagagtttggattcatcggcaagcatctctttcacggtatcattgagaagcacgttgtgcatcacttgtttcccaagattcccttctacaaggctgacgaagccaccgaggccatcaagcctgtcattggcgaccactactgtcacgacgatcggtccttcctgggtcagctgtggaccatcttcggaactctcaagtacgtggagcacgatcctgcccgacccggtgccatgcgatggaacaaggactaagcggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaatttaaatgtaacgaaactgaaatttgaccagatattgtgtccgcggtggagctccagcttttgttccctttagtgagggttaatttcgagcttggcgtaatcatggtcatagctgtttcctgtgtgaaattgttatccgctcacaagcttccacacaacgtacgttgattgaggtggagccagatgggctattgtttcatatatagactggcagccacctctttggcccagcatgtttgtatacctggaagggaaaactaaagaagctggctagtttagtttgattattatagtagatgtcctaatcactagagattagaatgtcttggcgatgattagtcgtcgtcccctgtatcatgtctagaccaactgtgtcatgaagttggtgctggtgttttacctgtgtactacaagtaggtgtcctagatctagtgtacagagccgtttagacccatgtggacttcaccattaacgatggaaaatgttcattatatgacagtatattacaatggacttgctccatttcttccttgcatcacatgttctccacctccatagttgatcaacacatcatagtagctaaggctgctgctctcccactacagtccaccacaagttaagtagcaccgtcagtacagctaaaagtacacgtctagtacgtttcataactagtcaagtagcccctattacagatatcagcactatcacgcacgagtttttctctgtgctatctaatcaacttgccaagtattcggagaagatacactttcttggcatcaggtatacgagggagcctatcagatgaaaaagggtatattggatccattcatatccacctacacgttgtcataatctcctcattcacgtgattcatttcgtgacactagtttctcactttcccccccgcacctatagtcaacttggcggacacgctacttgtagctgacgttgatttatagacccaatcaaagcgggttatcggtcaggtagcacttatcattcatcgttcatactacgatgagcaatctcgggcatgtccggaaaagtgtcgggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcattccgacagcagcgactgggcaccatgatcaagcgaaacaccttcccccagctgccctggcaaaccatcaagaaccctactttcatcaagtgcaagaacggttctactcttctcacctccggtgtctacggctggtgccgaaagcctaactacaccgctgatttcatcatgtgcctcacctgggctctcatgtgcggtgttgcttctcccctgccttacttctacccggtcttcttcttcctggtgctcatccaccgagcttaccgagactttgagcgactggagcgaaagtacggtgaggactaccaggagttcaagcgacaggtcccttggatcttcatcccttatgttttctaaacgataagcttagtgagcgaatggtgaggttacttaattgagtggccagcctatgggattgtataacagacagtcaatatattactgaaaagactgaacagccagacggagtgaggttgtgagtgaatcgtagagggcggctattacagcaagtctactctacagtgtactaacacagcagagaacaaatacaggtgtgcattcggctatctgagaattagttggagagctcgagaccctcggcgataaactgctcctcggttttgtgtccatacttgtacggaccattgtaatggggcaagtcgttgagttctcgtcgtccgacgttcagagcacagaaaccaatgtaatcaatgtagcagagatggttctgcaaaagattgatttgtgcgagcaggttaattaagttgcgacacatgtcttgatagtatcttgaattctctctcttgagcttttccataacaagttcttctgcctccaggaagtccatgggtggtttgatcatggttttggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgaccttttccttgggaaccaccaccgtcagcccttctgactcacgtattgtagccaccgacacaggcaacagtccgtggatagcagaatatgtcttgtcggtccatttctcaccaactttaggcgtcaagtgaatgttgcagaagaagtatgtgccttcattgagaatcggtgttgctgatttcaataaagtcttgagatcagtttggccagtcatgttgtggggggtaattggattgagttatcgcctacagtctgtacaggtatactcgctgcccactttatactttttgattccgctgcacttgaagcaatgtcgtttaccaaaagtgagaatgctccacagaacacaccccagggtatggttgagcaaaaaataaacactccgatacggggaatcgaaccccggtctccacggttctcaagaagtattcttgatgagagcgtatcgatgagcctaaaatgaacccgagtatatctcataaaattctcggtgagaggtctgtgactgtcagtacaaggtgccttcattatgccctcaaccttaccatacctcactgaatgtagtgtacctctaaaaatgaaatacagtgccaaaagccaaggcactgagctcgtctaacggacttgatatacaaccaattaaaacaaatgaaaagaaatacagttctttgtatcatttgtaacaattaccctgtacaaactaaggtattgaaatcccacaatattcccaaagtccacccctttccaaattgtcatgcctacaactcatataccaagcactaacctaccgtttaaaccatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacac

SEQ ID NO: 417 - DNA, 2173 bp, Yarrowia lipolytica
  CDS (547)..(1647): GenBank Accession No. AJ549519
gatatctgtaataggggctacttgactagttatgaaacgtactagacgtgtacttttagctgtactgacggtgctacttaacttgtggtggactgtagtgggagagcagcagccttagctactatgatgtgttgatcaactatggaggtggagaacatgtgatgcaaggaagaaatggagcaagtccattgtaatatactgtcatataatgaacattttccatcgttaatggtgaagtccacatgggtctaaacggctctgtacactagatctaggacacctacttgtagtacacaggtaaaacaccagcaccaacttcatgacacagttggtctagacatgatacaggggacgacgactaatcatcgccaagacattctaatctctagtgattaggacatctactataataatcaaactaaactagccagcttctttagttttcccttccaggtatacaaacatgctgggccaaagaggtggctgccagtctatatatgaaacaatagcccatctggctccacctcaatcaacgtcgacactaccatggtcagctttggagctcgaatcaaggacttcttttcggtactcctgtttggagctgcctccacctcttcttccaccaagaccgctcttgtttcgcagggcttctacgatgctgctctggacttttcccatctgtccaacattgcgtactgtgtgaatgcccccatcactccgttaaagagcgacttctcctgcggccagtcatgtgtacatttcccggatattgagctggtccacatctttggaggcgacttcttctccacatctatcaccggataccttgctctggaccacgtcaagaaggagaagtatgtggtcttccgaggtaccttctccattgccgatgctatcaccgacatccagttccagcagtcctcctttctggtaaatgttccagctctcaacaccttcaccgccaacgatacagctccagaggcccagatcgattgcaaacagtgcaagatccatgacggcttctccaaggctttcaccgagacctggcacaacatcggagacctgctggagcagcatctcgactcgtatccagactaccaactgtacgtgacgggacactctctgggagccgcaatggcgttgttgggcgccacctccattaaactgagaggctacgaccccatcctgatcaactacggacagccccgagttggaaacaaggcgtttgcagactacatctccgcgctgtggtttggtaatggggacggcctggaaatcaaccagcagcgaagattgtatcgaatgacccactggaacgacgtgtttgtgggcctgcccaactgggacggatacactcactccaatggagaagtgtacatcaagggcaagtacgtcaaccctcctctgaaggacgtcttttcttgtgcaggaggagaaaactccaagtgctaccgatcggaattcaacctgctcgcacaaatcaatcttttgcagaaccatctctgctacattgattacattggtttctgtgctctgaacgtcggacgacgagaactcaacgacttgccccattacaatggtccgtacaagtatggacacaaaaccgaggagcagtttatcgccgagggtctcgagctctccaactaattctcagatagccgaatgcacacctgtatttgttctctgctgtgttagtacactgtagagtagacttgctgtaatagccgccctctacgattcactcacaacctcactccgtctggctgttcagtcttttcagtaatatattgactgtctgttatacaatcccataggctggccactcaattaagtaacctcaccattcgctcactaagcttatcgtttagaaaacataagggatgaagatccaagggacctgtcgcttgaactcctggtagtcctcaccgtactttcgctccagtcgctcaaagtctcggtaagctcggtggatgagcaccaggaagaagaagaccgggtagaagtaaggcaggggagaagcaacaccgcacatgagagcccaggtgaggcacatgatgaaatcagcggtgtagttaggctttcggcaccagccgtagacaccggaggtgagaagagtagaaccgttcttgcacttgatgaaagtagggttcttgatggtttgccagggcagctg

SEQ ID NO: 418 - protein, 366 aa, Yarrowia lipolytica
MVSFGARIKDFFSVLLFGAASTSSSTKTALVSQGFYDAALDFSHLSNIAYCVNAPITPLKSDFSCGQSCVHFPDIELVHIFGGDFFSTSITGYLALDHVKKEKYVVFRGTFSIADAITDIQFQQSSFLVNVPALNTFTANDTAPEAQIDCKQCKIHDGFSKAFTETWHNIGDLLEQHLDSYPDYQLYVTGHSLGAAMALLGATSIKLRGYDPILINYGQPRVGNKAFADYISALWFGNGDGLEINQQRRLYRMTHWNDVFVGLPNWDGYTHSNGEVYIKGKYVNPPLKDVFSCAGGENSKCYRSEFNLLAQINLLQNHLCYIDYIGFCALNVGRRELNDLPHYNGPYKYGHKTEEQFIAEGLELSN

SEQ ID NO: 419 - DNA, 792 bp, Eutreptiella sp. CCMP389
  CDS (1)..(792): delta-9 elongase
  ref <302>: TITLE: DELTA-9 ELONGASES AND THEIR USE IN MAKING POLYUNSATURATED FATTY ACIDS
  ref <310>: PATENT DOCUMENT NUMBER: WO 2007/061742
  ref <311>: PATENT FILING DATE: 2006-11-16
  ref <312>: PUBLICATION DATE: 2007-05-31
  ref <313>: RELEVANT RESIDUES IN SEQ ID NO: (1)..(792)
  ref <302>: TITLE: DELTA-9 ELONGASES AND THEIR USE IN MAKING POLYUNSATURATED FATTY ACIDS
  ref <310>: PATENT DOCUMENT NUMBER: US 2007-0117190-A1
  ref <311>: PATENT FILING DATE: 2006-11-16
  ref <312>: PUBLICATION DATE: 2007-05-24
  ref <313>: RELEVANT RESIDUES IN SEQ ID NO: (1)..(792)
atggctgcggtgatagaggtcgccaacgagtttgtagccatcacggcagaaacgctccccaaagttgactatcaacgactatggcgagacatttacagttgtgagctactgtatttctccattgccttcgtgatcttgaagtttacgttgggcgagttgagcgacagcggaaaaaagattttgagagtgttgttcaagtggtacaatctcttcatgtccgtgttctccttggtgtctttcctttgcatgggctatgccatttataccgtgggcctatactctaacgaatgcgacagggctttcgacaactcgttgttccgctttgcaacaaaggtgttctactacagtaagtttttggagtacatcgactctttttatcttccgctcatggccaagccgctgtctttcctgcaattcttccatcacttgggagcccccatggacatgtggctctttgtccaatattctggggaatctatttggatctttgtgtttttgaatgggttcattcactttgttatgtacgggtactactggactcggctgatgaagttcaatttcccaatgcccaagcagttgattaccgcgatgcagatcacgcagttcaacgttggtttctacctcgtgtggtggtacaaagatattccctgctaccgaaaggatcccatgcgaatgttggcctggatcttcaattactggtatgttgggactgtcttgctgctgttcattaatttcttcgtcaaatcctatgtgttcccaaagccgaagactgcagataaaaaggtccaatag

SEQ ID NO: 420 - protein, 263 aa, Eutreptiella sp. CCMP389; identical to SEQ ID NO: 359

SEQ ID NO: 421 - DNA, 774 bp, Euglena anabaena UTEX 373
  CDS (1)..(774): synthetic delta-9 elongase (codon-optimized for Yarrowia lipolytica)
atggaggctgccaaggagctggtctccatcgtccaggaggaacttcccaaggtggactacgcccagctctggcaggacgcctcctcttgcgaggttctgtacctctcggtcgctttcgtggccatcaagttcatgcttcgacctctggacctcaagcgacaagccaccctcaaaaagctgttcaccgcatacaactttctcatgtccatctactcgttcggctccttcctggcgatggcctacgctctctctgtcactggtattctttccggcgattgtgagactgccttcaacaatgacgtgttccgaatcaccactcagctgttctacctcagcaagttcgtcgagtacatcgactccttctaccttcccctcatggacaagcccttgtcgtttctgcagttctttcaccatctcggagctcccatcgacatgtggctgttctacaagtatcgaaacgaaggcgtctggatctttgttctgctcaacggcttcattcactggatcatgtacggttactattggacgcgactcatcaagctgaacttccctatgcccaagaacctcattacctccatgcaaattatccagttcaacgtcggattctacatcgtctggaagtaccgaaacgtgccctgctaccggcaggacggtatgcgaatgtttgcctggatcttcaactactggtatgtcggcacggtgctgcttctgttcctcaacttctacgtccagacctacattcggaagcctcgaaagaaccgaggcaaaaaggag

SEQ ID NO: 422 - protein, 258 aa, Euglena anabaena UTEX 373; identical to SEQ ID NO: 254

SEQ ID NO: 423 - DNA, 1271 bp, Euglena gracilis
  CDS (4)..(1269): delta-8 desaturase ("Eg5" or "EgD8")
  ref <302>: TITLE: DELTA-8 DESATURASE AND ITS USE IN MAKING POLYUNSATURATED FATTY ACIDS
  ref <310>: PATENT DOCUMENT NUMBER: WO 2006/012325 and WO 2006/012326
  ref <311>: PATENT FILING DATE: 2005-06-24
  ref <312>: PUBLICATION DATE: 2006-02-02
  ref <313>: RELEVANT RESIDUES IN SEQ ID NO: (1)..(1271)
  ref <302>: TITLE: DELTA-8 DESATURASE AND ITS USE IN MAKING POLYUNSATURATED FATTY ACIDS
  ref <310>: PATENT DOCUMENT NUMBER: US-2005-0287652-A1
  ref <311>: PATENT FILING DATE: 2005-06-24
  ref <312>: PUBLICATION DATE: 2005-12-29
  ref <313>: RELEVANT RESIDUES IN SEQ ID NO: (1)..(1271)
gaaatgaagtcaaagcgccaagcgcttccccttacaattgatggaacaacatatgatgtgtctgcctgggtcaatttccaccctggtggtgcggaaattatagagaattaccaaggaagggatgccactgatgccttcatggttatgcactctcaagaagccttcgacaagctcaagcgcatgcccaaaatcaatcccagttctgagttgccaccccaggctgcagtgaatgaagctcaagaggatttccggaagctccgagaagagttgatcgcaactggcatgtttgatgcctcccccctctggtactcatacaaaatcagcaccacactgggccttggagtgctgggttatttcctgatggttcagtatcagatgtatttcattggggcagtgttgcttgggatgcactatcaacagatgggctggctttctcatgacatttgccaccaccagactttcaagaaccggaactggaacaacctcgtgggactggtatttggcaatggtctgcaaggtttttccgtgacatggtggaaggacagacacaatgcacatcattcggcaaccaatgttcaagggcacgaccctgatattgacaacctccccctcttagcctggtctgaggatgacgtcacacgggcgtcaccgatttcccgcaagctcattcagttccagcagtactatttcttggtcatctgtatcttgttgcggttcatttggtgtttccagagcgtgttgaccgtgcgcagtttgaaggacagagataaccaattctatcgctctcagtataagaaggaggccattggcctcgccctgcactggaccttgaagaccctgttccacttattctttatgcccagcatcctcacatcgctgttggtgtttttcgtttcggagctggttggcggcttcggcattgcgatcgtggtgttcatgaaccactacccactggagaagatcggggactcagtctgggatggccatggattctcggttggccagatccatgagaccatgaacattcggcgagggattatcacagattggtttttcggaggcttgaattaccagattgagcaccatttgtggccgaccctccctcgccacaacctgacagcggttagctaccaggtggaacagctgtgccagaagcacaacctgccgtatcggaacccgctgccccatgaagggttggtcatcctgctgcgctatctggcggtgttcgcccggatggcggagaagcaacccgcggggaaggctctataagg

SEQ ID NO: 424 - protein, 421 aa, Euglena gracilis
MKSKRQALPLTIDGTTYDVSAWVNFHPGGAEIIENYQGRDATDAFMVMHSQEAFDKLKRMPKINPSSELPPQAAVNEAQEDFRKLREELIATGMFDASPLWYSYKISTTLGLGVLGYFLMVQYQMYFIGAVLLGMHYQQMGWLSHDICHHQTFKNRNWNNLVGLVFGNGLQGFSVTWWKDRHNAHHSATNVQGHDPDIDNLPLLAWSEDDVTRASPISRKLIQFQQYYFLVICILLRFIWCFQSVLTVRSLKDRDNQFYRSQYKKEAIGLALHWTLKTLFHLFFMPSILTSLLVFFVSELVGGFGIAIVVFMNHYPLEKIGDSVWDGHGFSVGQIHETMNIRRGIITDWFFGGLNYQIEHHLWPTLPRHNLTAVSYQVEQLCQKHNLPYRNPLPHEGLVILLRYLAVFARMAEKQPAGKAL

SEQ ID NO: 425 - DNA, 1272 bp, Euglena gracilis
  CDS (2)..(1270): synthetic delta-8 desaturase (codon-optimized for Yarrowia lipolytica) ("D8SF" or "EgD8S")
  ref <302>: TITLE: DELTA-8 DESATURASE AND ITS USE IN MAKING POLYUNSATURATED FATTY ACIDS
  ref <310>: PATENT DOCUMENT NUMBER: WO 2006/012325 and WO 2006/012326
  ref <311>: PATENT FILING DATE: 2005-06-24
  ref <312>: PUBLICATION DATE: 2006-02-02
  ref <313>: RELEVANT RESIDUES IN SEQ ID NO: (1)..(1272)
  ref <302>: TITLE: DELTA-8 DESATURASE AND ITS USE IN MAKING POLYUNSATURATED FATTY ACIDS
  ref <310>: PATENT DOCUMENT NUMBER: US-2005-0287652-A1
  ref <311>: PATENT FILING DATE: 2005-06-24
  ref <312>: PUBLICATION DATE: 2005-12-29
  ref <313>: RELEVANT RESIDUES IN SEQ ID NO: (1)..(1272)
catggtgaagtccaagcgacaggctctgcccctcaccatcgacggaactacctacgacgtctccgcttgggtgaacttccaccctggtggagctgaaatcattgagaactaccagggacgagatgctactgacgccttcatggttatgcactctcaggaagccttcgacaagctcaagcgaatgcccaagatcaacccctcctccgagctgcctccccaggctgccgtcaacgaagctcaggaggatttccgaaagctccgagaagagctgatcgccactggcatgtttgacgcctctcccctctggtactcgtacaagatctccaccaccctgggtcttggcgtgcttggatacttcctgatggtccagtaccagatgtacttcattggtgctgtgctgctcggtatgcactaccagcaaatgggatggctgtctcatgacatctgccaccaccagaccttcaagaaccgaaactggaataacctcgtgggtctggtctttggcaacggactccagggcttctccgtgacctggtggaaggacagacacaacgcccatcattctgctaccaacgttcagggtcacgatcccgacattgataacctgcctctgctcgcctggtccgaggacgatgtcactcgagcttctcccatctcccgaaagctcattcagttccaacagtactatttcctggtcatctgtattctcctgcgattcatctggtgtttccagtctgtgctgaccgttcgatccctcaaggaccgagacaaccagttctaccgatctcagtacaagaaagaggccattggactcgctctgcactggactctcaagaccctgttccacctcttctttatgccctccatcctgacctcgctcctggtgttctttgtttccgagctcgtcggtggcttcggaattgccatcgtggtcttcatgaaccactaccctctggagaagatcggtgattccgtctgggacggacatggcttctctgtgggtcagatccatgagaccatgaacattcgacgaggcatcattactgactggttctttggaggcctgaactaccagatcgagcaccatctctggcccaccctgcctcgacacaacctcactgccgtttcctaccaggtggaacagctgtgccagaagcacaacctcccctaccgaaaccctctgccccatgaaggtctcgtcatcctgctccgatacctggccgtgttcgctcgaatggccgagaagcagcccgctggcaaggctctctaagc

SEQ ID NO: 426 - protein, 422 aa, Euglena gracilis
MVKSKRQALPLTIDGTTYDVSAWVNFHPGGAEIIENYQGRDATDAFMVMHSQEAFDKLKRMPKINPSSELPPQAAVNEAQEDFRKLREELIATGMFDASPLWYSYKISTTLGLGVLGYFLMVQYQMYFIGAVLLGMHYQQMGWLSHDICHHQTFKNRNWNNLVGLVFGNGLQGFSVTWWKDRHNAHHSATNVQGHDPDIDNLPLLAWSEDDVTRASPISRKLIQFQQYYFLVICILLRFIWCFQSVLTVRSLKDRDNQFYRSQYKKEAIGLALHWTLKTLFHLFFMPSILTSLLVFFVSELVGGFGIAIVVFMNHYPLEKIGDSVWDGHGFSVGQIHETMNIRRGIITDWFFGGLNYQIEHHLWPTLPRHNLTAVSYQVEQLCQKHNLPYRNPLPHEGLVILLRYLAVFARMAEKQPAGKAL

SEQ ID NO: 427 - DNA, 1260 bp, Euglena anabaena UTEX 373
  CDS (1)..(1260): delta-8 desaturase
atggtgaaaaggccagcacttccgctgaccgttgatggtgtcacctatgatgtgtctgcctggttgaaccatcatccagggggtgctgacatcattgagaactaccgcggtcgtgatgccactgatgtctttatggttatgcactctgaaaatgctgtgagtaaactaagaaggatgcctatcatggaaccatcatctccactgacgcctacgccaccgaaacccaactcagacgaaccgcaggaggatttccgcaagctccgagatgagctcatcgcagcaggaatgttcgacgcatcaccgatgtggtacgcatataagacgctcagtacgctgggcctcggggtcctcgcggtgctattgatgacccagtggcactggtacctcgtcggggcaatcgtgttgggcattcacttccaacaaatgggttggttgtcgcacgatatctgccaccatcagctgttcaaggaccgatcgatcaacaacgccatcggcttgcttttcgggaacgtcttgcaagggttctctgtgacctggtggaaggacaggcacaatgcacaccactccgccaccaacgtgcaaggccacgaccccgacattgacaacctgccgctgctggcatggtccaaggaggacgtggagagggccggcccgttctcacggcggatgatcaagtaccagcaatactacttcttcttcatctgtgccctcctgaggttcatctggtgcttccagagcatccacacagccacgggcctgaaggatcgcagcaaccagtactaccgcaggcagtacgagaaagagagcgtgggcctggccctccactggggcctgaaggcgttgttctactacttttatatgccaagcttcttgaccggactcatggtgtttttcgtgtccgagttgcttgggggcttcggcatcgccatcgtggtgttcatgaaccactaccccctggagaagatccaggactcggtgtgggacggccacggcttttgcgccggccagattcacgaaacgatgaacgtccagcggggactcgtcacggactggttcttcggtgggctgaattaccaaatcgagcaccacctgtggccgacgctgccccggcacaacctgacggcggccagcatcaaagtggagcagttgtgcaagaagcacaacttgccgtatcgcagccccccaatgctggagggggtgggcatcctgatcagctacctgggcacctttgcccgcatggtggcaaaggccgacaaggcg

SEQ ID NO: 428 - protein, 420 aa, Euglena anabaena UTEX 373
MVKRPALPLTVDGVTYDVSAWLNHHPGGADIIENYRGRDATDVFMVMHSENAVSKLRRMPIMEPSSPLTPTPPKPNSDEPQEDFRKLRDELIAAGMFDASPMWYAYKTLSTLGLGVLAVLLMTQWHWYLVGAIVLGIHFQQMGWLSHDICHHQLFKDRSINNAIGLLFGNVLQGFSVTWWKDRHNAHHSATNVQGHDPDIDNLPLLAWSKEDVERAGPFSRRMIKYQQYYFFFICALLRFIWCFQSIHTATGLKDRSNQYYRRQYEKESVGLALHWGLKALFYYFYMPSFLTGLMVFFVSELLGGFGIAIVVFMNHYPLEKIQDSVWDGHGFCAGQIHETMNVQRGLVTDWFFGGLNYQIEHHLWPTLPRHNLTAASIKVEQLCKKHNLPYRSPPMLEGVGILISYLGTFARMVAKADKA

SEQ ID NO: 429 - DNA, 1260 bp, Euglena anabaena UTEX 373
  CDS (1)..(1260): synthetic delta-8 desaturase (codon-optimized for Yarrowia lipolytica)
atggtcaagcgacccgctctgcctctcaccgtggacggtgtcacctacgacgtttctgcctggctcaaccaccatcccggaggtgccgacattatcgagaactaccgaggtcgggatgctaccgacgtcttcatggttatgcactccgagaacgccgtgtccaaactcagacgaatgcccatcatggaaccttcctctcccctgactccaacacctcccaagccaaactccgacgaacctcaggaggatttccgaaagctgcgagacgagctcattgctgcaggcatgttcgatgcctctcccatgtggtacgcttacaagaccctgtcgactctcggactgggtgtccttgccgtgctgttgatgacccagtggcactggtacctggttggtgctatcgtcctcggcattcactttcaacagatgggatggctctcgcacgacatttgccatcaccagctgttcaaggaccgatccatcaacaatgccattggcctgctcttcggaaacgtgcttcagggcttttctgtcacttggtggaaggaccgacacaacgctcatcactccgccaccaacgtgcagggtcacgatcccgacatcgacaacctgcctctcctggcgtggtccaaggaggacgtcgagcgagctggcccgttttctcgacggatgatcaagtaccaacagtattacttctttttcatctgtgcccttctgcgattcatctggtgctttcagtccattcatactgccacgggtctcaaggatcgaagcaatcagtactatcgaagacagtacgagaaggagtccgtcggtctggcactccactggggtctcaaggccttgttctactatttctacatgccctcgtttctcaccggactcatggtgttctttgtctccgagctgcttggtggcttcggaattgccatcgttgtcttcatgaaccactaccctctggagaagattcaggactccgtgtgggatggtcatggcttctgtgctggacagattcacgagaccatgaacgttcagcgaggcctcgtcacagactggtttttcggtggcctcaactaccagatcgaacatcacctgtggcctactcttcccagacacaacctcaccgctgcctccatcaaagtggagcagctgtgcaagaagcacaacctgccctaccgatctcctcccatgctcgaaggtgtcggcattcttatctcctacctgggcaccttcgctcgaatggttgccaaggcagacaaggcc

SEQ ID NO: 430 - protein, 420 aa, Euglena anabaena UTEX 373; identical to SEQ ID NO: 428

SEQ ID NO: 431 - DNA, 7769 bp, Artificial Sequence
  Plasmid pZuFmEgD9ES
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggaggtcgtgaacgaaatcgtctccattggccaggaggttcttcccaaggtcgactatgctcagctctggtctgatgcctcgcactgcgaggtgctgtacctctccatcgccttcgtcatcctgaagttcacccttggtcctctcggacccaagggtcagtctcgaatgaagtttgtgttcaccaactacaacctgctcatgtccatctactcgctgggctccttcctctctatggcctacgccatgtacaccattggtgtcatgtccgacaactgcgagaaggctttcgacaacaatgtcttccgaatcaccactcagctgttctacctcagcaagttcctcgagtacattgactccttctatctgcccctcatgggcaagcctctgacctggttgcagttctttcaccatctcggagctcctatggacatgtggctgttctacaactaccgaaacgaagccgtttggatctttgtgctgctcaacggcttcattcactggatcatgtacggctactattggacccgactgatcaagctcaagttccctatgcccaagtccctgattacttctatgcagatcattcagttcaacgttggcttctacatcgtctggaagtaccggaacattccctgctaccgacaagatggaatgagaatgtttggctggtttttcaactacttctacgttggtactgtcctgtgtctgttcctcaacttctacgtgcagacctacatcgtccgaaagcacaagggagccaaaaagattcagtgagc

SEQ ID NO: 432 - DNA, 7778 bp, Artificial Sequence
  Plasmid pZuFmEgD9ES-Na
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggaggtcgtgaacgaaatcgtctccattggccaggaggttcttcccaaggtcgactatgctcagctctggtctgatgcctcgcactgcgaggtgctgtacctctccatcgccttcgtcatcctgaagttcacccttggtcctctcggacccaagggtcagtctcgaatgaagtttgtgttcaccaactacaacctgctcatgtccatctactcgctgggctccttcctctctatggcctacgccatgtacaccattggtgtcatgtccgacaactgcgagaaggctttcgacaacaatgtcttccgaatcaccactcagctgttctacctcagcaagttcctcgagtacattgactccttctatctgcccctcatgggcaagcctctgacctggttgcagttctttcaccatctcggagctcctatggacatgtggctgttctacaactaccgaaacgaagccgtttggatctttgtgctgctcaacggcttcattcactggatcatgtacggctactattggacccgactgatcaagctcaagttccctatgcccaagtccctgattacttctatgcagatcattcagttcaacgttggcttctacatcgtctggaagtaccggaacattccctgctaccgacaagatggaatgagaatgtttggctggtttttcaactacttctacgttggtactgtcctgtgtctgttcctcaacttctacgtgcagacctacatcgtccgaaagcacaagggagccaaaaagattcagggcgccatctgagc

SEQ ID NO: 433 - DNA, 45 bp, Artificial Sequence
  Primer YL989
ggagccaaaaagattcagggcgccatctgagcggccgcaagtgtg

SEQ ID NO: 434 - DNA, 45 bp, Artificial Sequence
  Primer YL990
cacacttgcggccgctcagatggcgccctgaatctttttggctcc

SEQ ID NO: 435 - DNA, 99 bp, Artificial Sequence
  Primer YL991
tttggcgccggtcccgctcgacctgccggacttcctcccgctacctactacgactctctggccgtcatggtgaaggcttctcgacaggctctgcccctc

SEQ ID NO: 436 - DNA, 33 bp, Artificial Sequence
  Primer YL992
tggtcaagatcttgtacgagtaccagaggggag

SEQ ID NO: 437 - DNA, 8428 bp, Artificial Sequence
  Plasmid pKO2UFm8A
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgggtgaagcttccactggtcggcgtggtagtggggcagagtggggtcggtgtgctgcaggtaggtgatggccacgagccagtggttgacccacaggtaggggatcaggtagtagagggtgacggaagccaggccccatcggttgatggagtatgcgatgacggacatggtgataccaataccgacgttagagatccagatgttgaaccagtccttcttctcaaacagcggggcgttggggttgaagtggttgacagcccatttgttgagcttggggtacttctgtccggtaacgtaagacagcagatacagaggccatccaaacacctgctgggtgatgaggccgtagagggtcatgaggggagcgtcctcagcaagctcagaccagtcatgggcgcctcggttctccataaactcctttcggtccttgggcacaaacaccatatcacgggtgaggtgaccagtggacttgtggtgcatggagtgggtcagcttccaggcgtagtaagggaccagcatggaggagtgcagaacccatccggtgacgttgttgacggtgttagagtcggagaaagcagagtggccacactcgtgggcaagaacccacagaccggtgccaaacagaccctggacaatggagtacatggcccaggccacagctcggccggaagccgagggaataagaggcaggtacgcgtaggccatgtaggcaaaaacggcgataaagaagcaggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcttgaatctacaagtaggagggttggagtgattaagtgaaacttctttaacggctctatgccagttctattgatatccgaaacatcagtatgaaggtctgataagggtgacttcttcccacagattcgtatcagtacgagtacgagaccggtacttgtaacagtattgatactaaagggaaactacaacggttgtcagcgtaatgtgacttcgcccatgaacgcagacacgcagtgccgagtgcggtgatatcgcctactcgttacgtccatggactacacaacccctcggcttcgcttggcttagcctcgggctcggtgctgttcagttaaaacacaatcaaataacatttctactttttagaaggcaggccgtcaggagcaactccgactccattgacgtttctaaacatctgaatgccttccttaccttcaacaaactggcaggttcgggcgacagtgtaaagagacttgatgaagttggtgtcgtcgtgtcggtagtgcttgcccatgaccttcttgatcttctcagtggcgattcgggcgttgtagaagggaattccgtcgtcgcctgagtcgacgagtatctgtctgactcgtcattgccgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagctaacgtccacaagtccgcctttgccgctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtacccggaaccggaatcattgctggcctgcgagctggtgccgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgacttaattaatttgaatcgaatcgatgagcctaaaatgaacccgagtatatctcataaaattctcggtgagaggtctgtgactgtcagtacaaggtgccttcattatgccctcaaccttaccatacctcactgaatgtagtgtacctctaaaaatgaaatacagtgccaaaagccaaggcactgagctcgtctaacggacttgatatacaaccaattaaaacaaatgaaaagaaatacagttctttgtatcatttgtaacaattaccctgtacaaactaaggtattgaaatcccacaatattcccaaagtccacccctttccaaattgtcatgcctacaactcatataccaagcactaacctaccgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggtgaaggcttctcgacaggctctgcccctcgtcatcgacggaaaggtgtacgacgtctccgcttgggtgaacttccaccctggtggagctgaaatcattgagaactaccagggacgagatgctactgacgccttcatggttatgcactctcaggaagccttcgacaagctcaagcgaatgcccaagatcaaccaggcttccgagctgcctccccaggctgccgtcaacgaagctcaggaggatttccgaaagctccgagaagagctgatcgccactggcatgtttgacgcctctcccctctggtactcgtacaagatcttgaccaccctgggtcttggcgtgcttgccttcttcatgctggtccagtaccacctgtacttcattggtgctctcgtgctcggtatgcactaccagcaaatgggatggctgtctcatgacatctgccaccaccagaccttcaagaaccgaaactggaataacgtcctgggtctggtctttggcaacggactccagggcttctccgtgacctggtggaaggacagacacaacgcccatcattctgctaccaacgttcagggtcacgatcccgacattgataacctgcctctgctcgcctggtccgaggacgatgtcactcgagcttctcccatctcccgaaagctcattcagttccaacagtactatttcctggtcatctgtattctcctgcgattcatctggtgtttccagtctgtgctgaccgttcgatccctcaaggaccgagacaaccagttctaccgatctcagtacaagaaagaggccattggactcgctctgcactggactctcaagaccctgttccacctcttctttatgccctccatcctgacctcgatgctggtgttctttgtttccgagctcgtcggtggcttcggaattgccatcgtggtcttcatgaaccactaccctctggagaagatcggtgattccgtctgggacggacatggcttctctgtgggtcagatccatgagaccatgaacattcgacgaggcatcattactgactggttctttggaggcctgaactaccagatcgagcaccatctctggcccaccctgcctcgacacaacctcactgccgtttcctaccaggtggaacagctgtgccagaagcacaacctcccctaccgaaaccctctgccccatgaaggtctcgtcatcctgctccgatacctgtcccagttcgctcgaatggccgagaagcagcccggtgccaaggctcagtaagc

SEQ ID NO: 438 - protein, 19 aa, Artificial Sequence
  Multizyme linker
GPARPAGLPPATYYDSLAV

SEQ ID NO: 439 - DNA, 9098 bp, Artificial Sequence
  Plasmid pZUFmG9G8fu
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggaggtcgtgaacgaaatcgtctccattggccaggaggttcttcccaaggtcgactatgctcagctctggtctgatgcctcgcactgcgaggtgctgtacctctccatcgccttcgtcatcctgaagttcacccttggtcctctcggacccaagggtcagtctcgaatgaagtttgtgttcaccaactacaacctgctcatgtccatctactcgctgggctccttcctctctatggcctacgccatgtacaccattggtgtcatgtccgacaactgcgagaaggctttcgacaacaatgtcttccgaatcaccactcagctgttctacctcagcaagttcctcgagtacattgactccttctatctgcccctcatgggcaagcctctgacctggttgcagttctttcaccatctcggagctcctatggacatgtggctgttctacaactaccgaaacgaagccgtttggatctttgtgctgctcaacggcttcattcactggatcatgtacggctactattggacccgactgatcaagctcaagttccctatgcccaagtccctgattacttctatgcagatcattcagttcaacgttggcttctacatcgtctggaagtaccggaacattccctgctaccgacaagatggaatgagaatgtttggctggtttttcaactacttctacgttggtactgtcctgtgtctgttcctcaacttctacgtgcagacctacatcgtccgaaagcacaagggagccaaaaagattcagggcgccggtcccgctcgacctgccggacttcctcccgctacctactacgactctctggccgtcatggtgaaggcttctcgacaggctctgcccctcgtcatcgacggaaaggtgtacgacgtctccgcttgggtgaacttccaccctggtggagctgaaatcattgagaactaccagggacgagatgctactgacgccttcatggttatgcactctcaggaagccttcgacaagctcaagcgaatgcccaagatcaaccaggcttccgagctgcctccccaggctgccgtcaacgaagctcaggaggatttccgaaagctccgagaagagctgatcgccactggcatgtttgacgcctctcccctctggtactcgtacaagatcttgaccaccctgggtcttggcgtgcttgccttcttcatgctggtccagtaccacctgtacttcattggtgctctcgtgctcggtatgcactaccagcaaatgggatggctgtctcatgacatctgccaccaccagaccttcaagaaccgaaactggaataacgtcctgggtctggtctttggcaacggactccagggcttctccgtgacctggtggaaggacagacacaacgcccatcattctgctaccaacgttcagggtcacgatcccgacattgataacctgcctctgctcgcctggtccgaggacgatgtcactcgagcttctcccatctcccgaaagctcattcagttccaacagtactatttcctggtcatctgtattctcctgcgattcatctggtgtttccagtctgtgctgaccgttcgatccctcaaggaccgagacaaccagttctaccgatctcagtacaagaaagaggccattggactcgctctgcactggactctcaagaccctgttccacctcttctttatgccctccatcctgacctcgatgctggtgttctttgtttccgagctcgtcggtggcttcggaattgccatcgtggtcttcatgaaccactaccctctggagaagatcggtgattccgtctgggacggacatggcttctctgtgggtcagatccatgagaccatgaacattcgacgaggcatcattactgactggttctttggaggcctgaactaccagatcgagcaccatctctggcccaccctgcctcgacacaacctcactgccgtttcctaccaggtggaacagctgtgccagaagcacaacctcccctaccgaaaccctctgccccatgaaggtctcgtcatcctgctccgatacctgtcccagttcgctcgaatggccgagaagcagcccggtgccaaggctcagtaagc

SEQ ID NO: 440 - DNA, 2106 bp, Artificial Sequence
  Multizyme: EgD9ES/EgD8M gene fusion
  CDS (1)..(2106): Multizyme: EgD9ES/EgD8M gene fusion
atggaggtcgtgaacgaaatcgtctccattggccaggaggttcttcccaaggtcgactatgctcagctctggtctgatgcctcgcactgcgaggtgctgtacctctccatcgccttcgtcatcctgaagttcacccttggtcctctcggacccaagggtcagtctcgaatgaagtttgtgttcaccaactacaacctgctcatgtccatctactcgctgggctccttcctctctatggcctacgccatgtacaccattggtgtcatgtccgacaactgcgagaaggctttcgacaacaatgtcttccgaatcaccactcagctgttctacctcagcaagttcctcgagtacattgactccttctatctgcccctcatgggcaagcctctgacctggttgcagttctttcaccatctcggagctcctatggacatgtggctgttctacaactaccgaaacgaagccgtttggatctttgtgctgctcaacggcttcattcactggatcatgtacggctactattggacccgactgatcaagctcaagttccctatgcccaagtccctgattacttctatgcagatcattcagttcaacgttggcttctacatcgtctggaagtaccggaacattccctgctaccgacaagatggaatgagaatgtttggctggtttttcaactacttctacgttggtactgtcctgtgtctgttcctcaacttctacgtgcagacctacatcgtccgaaagcacaagggagccaaaaagattcagggcgccggtcccgctcgacctgccggacttcctcccgctacctactacgactctctggccgtcatggtgaaggcttctcgacaggctctgcccctcgtcatcgacggaaaggtgtacgacgtctccgcttgggtgaacttccaccctggtggagctgaaatcattgagaactaccagggacgagatgctactgacgccttcatggttatgcactctcaggaagccttcgacaagctcaagcgaatgcccaagatcaaccaggcttccgagctgcctccccaggctgccgtcaacgaagctcaggaggatttccgaaagctccgagaagagctgatcgccactggcatgtttgacgcctctcccctctggtactcgtacaagatcttgaccaccctgggtcttggcgtgcttgccttcttcatgctggtccagtaccacctgtacttcattggtgctctcgtgctcggtatgcactaccagcaaatgggatggctgtctcatgacatctgccaccaccagaccttcaagaaccgaaactggaataacgtcctgggtctggtctttggcaacggactccagggcttctccgtgacctggtggaaggacagacacaacgcccatcattctgctaccaacgttcagggtcacgatcccgacattgataacctgcctctgctcgcctggtccgaggacgatgtcactcgagcttctcccatctcccgaaagctcattcagttccaacagtactatttcctggtcatctgtattctcctgcgattcatctggtgtttccagtctgtgctgaccgttcgatccctcaaggaccgagacaaccagttctaccgatctcagtacaagaaagaggccattggactcgctctgcactggactctcaagaccctgttccacctcttctttatgccctccatcctgacctcgatgctggtgttctttgtttccgagctcgtcggtggcttcggaattgccatcgtggtcttcatgaaccactaccctctggagaagatcggtgattccgtctgggacggacatggcttctctgtgggtcagatccatgagaccatgaacattcgacgaggcatcattactgactggttctttggaggcctgaactaccagatcgagcaccatctctggcccaccctgcctcgacacaacctcactgccgtttcctaccaggtggaacagctgtgccagaagcacaacctcccctaccgaaaccctctgccccatgaaggtctcgtcatcctgctccgatacctgtcccagttcgctcgaatggccgagaagcagcccggtgccaaggctcagtaa

SEQ ID NO: 441 - protein, 701 aa, Artificial Sequence
  Synthetic Construct
MEVVNEIVSIGQEVLPKVDYAQLWSDASHCEVLYLSIAFVILKFTLGPLGPKGQSRMKFVFTNYNLLMSIYSLGSFLSMAYAMYTIGVMSDNCEKAFDNNVFRITTQLFYLSKFLEYIDSFYLPLMGKPLTWLQFFHHLGAPMDMWLFYNYRNEAVWIFVLLNGFIHWIMYGYYWTRLIKLKFPMPKSLITSMQIIQFNVGFYIVWKYRNIPCYRQDGMRMFGWFFNYFYVGTVLCLFLNFYVQTYIVRKHKGAKKIQGAGPARPAGLPPATYYDSLAVMVKASRQALPLVIDGKVYDVSAWVNFHPGGAEIIENYQGRDATDAFMVMHSQEAFDKLKRMPKINQASELPPQAAVNEAQEDFRKLREELIATGMFDASPLWYSYKILTTLGLGVLAFFMLVQYHLYFIGALVLGMHYQQMGWLSHDICHHQTFKNRNWNNVLGLVFGNGLQGFSVTWWKDRHNAHHSATNVQGHDPDIDNLPLLAWSEDDVTRASPISRKLIQFQQYYFLVICILLRFIWCFQSVLTVRSLKDRDNQFYRSQYKKEAIGLALHWTLKTLFHLFFMPSILTSMLVFFVSELVGGFGIAIVVFMNHYPLEKIGDSVWDGHGFSVGQIHETMNIRRGIITDWFFGGLNYQIEHHLWPTLPRHNLTAVSYQVEQLCQKHNLPYRNPLPHEGLVILLRYLSQFARMAEKQPGAKAQ

SEQ ID NO: 442 - DNA, 9104 bp, Artificial Sequence
  Plasmid pZUFmG9G8fu-B
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggaggtcgtgaacgaaatcgtctccattggccaggaggttcttcccaaggtcgactatgctcagctctggtctgatgcctcgcactgcgaggtgctgtacctctccatcgccttcgtcatcctgaagttcacccttggtcctctcggacccaagggtcagtctcgaatgaagtttgtgttcaccaactacaacctgctcatgtccatctactcgctgggctccttcctctctatggcctacgccatgtacaccattggtgtcatgtccgacaactgcgagaaggctttcgacaacaatgtcttccgaatcaccactcagctgttctacctcagcaagttcctcgagtacattgactccttctatctgcccctcatgggcaagcctctgacctggttgcagttctttcaccatctcggagctcctatggacatgtggctgttctacaactaccgaaacgaagccgtttggatctttgtgctgctcaacggcttcattcactggatcatgtacggctactattggacccgactgatcaagctcaagttccctatgcccaagtccctgattacttctatgcagatcattcagttcaacgttggcttctacatcgtctggaagtaccggaacattccctgctaccgacaagatggaatgagaatgtttggctggtttttcaactacttctacgttggtactgtcctgtgtctgttcctcaacttctacgtgcagacctacatcgtccgaaagcacaagggagccaaaaagattcagggcgccggtcccgctcgacctgccggacttcctcccgctacctactacgactctctggccgtcatgggatccgtgaaggcttctcgacaggctctgcccctcgtcatcgacggaaaggtgtacgacgtctccgcttgggtgaacttccaccctggtggagctgaaatcattgagaactaccagggacgagatgctactgacgccttcatggttatgcactctcaggaagccttcgacaagctcaagcgaatgcccaagatcaaccaggcttccgagctgcctccccaggctgccgtcaacgaagctcaggaggatttccgaaagctccgagaagagctgatcgccactggcatgtttgacgcctctcccctctggtactcgtacaagatcttgaccaccctgggtcttggcgtgcttgccttcttcatgctggtccagtaccacctgtacttcattggtgctctcgtgctcggtatgcactaccagcaaatgggatggctgtctcatgacatctgccaccaccagaccttcaagaaccgaaactggaataacgtcctgggtctggtctttggcaacggactccagggcttctccgtgacctggtggaaggacagacacaacgcccatcattctgctaccaacgttcagggtcacgatcccgacattgataacctgcctctgctcgcctggtccgaggacgatgtcactcgagcttctcccatctcccgaaagctcattcagttccaacagtactatttcctggtcatctgtattctcctgcgattcatctggtgtttccagtctgtgctgaccgttcgatccctcaaggaccgagacaaccagttctaccgatctcagtacaagaaagaggccattggactcgctctgcactggactctcaagaccctgttccacctcttctttatgccctccatcctgacctcgatgctggtgttctttgtttccgagctcgtcggtggcttcggaattgccatcgtggtcttcatgaaccactaccctctggagaagatcggtgattccgtctgggacggacatggcttctctgtgggtcagatccatgagaccatgaacattcgacgaggcatcattactgactggttctttggaggcctgaactaccagatcgagcaccatctctggcccaccctgcctcgacacaacctcactgccgtttcctaccaggtggaacagctgtgccagaagcacaacctcccctaccgaaaccctctgccccatgaaggtctcgtcatcctgctccgatacctgtcccagttcgctcgaatggccgagaagcagcccggtgccaaggctcagtaagc

SEQ ID NO: 443 - DNA, 39 bp, Artificial Sequence
  Primer YL1043
actctctggccgtcatgggatccgtgaaggcttctcgac

SEQ ID NO: 444 - DNA, 39 bp, Artificial Sequence
  Primer YL1044
gtcgagaagccttcacggatcccatgacggccagagagt

SEQ ID NO: 445 - protein, 24 aa, Artificial Sequence
  Multizyme linker
GAGPARPAGLPPATYYDSLAVMGS

SEQ ID NO: 446 - DNA, 2112 bp, Artificial Sequence
  Multizyme: EgD9ES/EgD8M gene fusion
  CDS (1)..(2112): Multizyme: EgD9ES/EgD8M gene fusion
atggaggtcgtgaacgaaatcgtctccattggccaggaggttcttcccaaggtcgactatgctcagctctggtctgatgcctcgcactgcgaggtgctgtacctctccatcgccttcgtcatcctgaagttcacccttggtcctctcggacccaagggtcagtctcgaatgaagtttgtgttcaccaactacaacctgctcatgtccatctactcgctgggctccttcctctctatggcctacgccatgtacaccattggtgtcatgtccgacaactgcgagaaggctttcgacaacaatgtcttccgaatcaccactcagctgttctacctcagcaagttcctcgagtacattgactccttctatctgcccctcatgggcaagcctctgacctggttgcagttctttcaccatctcggagctcctatggacatgtggctgttctacaactaccgaaacgaagccgtttggatctttgtgctgctcaacggcttcattcactggatcatgtacggctactattggacccgactgatcaagctcaagttccctatgcccaagtccctgattacttctatgcagatcattcagttcaacgttggcttctacatcgtctggaagtaccggaacattccctgctaccgacaagatggaatgagaatgtttggctggtttttcaactacttctacgttggtactgtcctgtgtctgttcctcaacttctacgtgcagacctacatcgtccgaaagcacaagggagccaaaaagattcagggcgccggtcccgctcgacctgccggacttcctcccgctacctactacgactctctggccgtcatgggatccgtgaaggcttctcgacaggctctgcccctcgtcatcgacggaaaggtgtacgacgtctccgcttgggtgaacttccaccctggtggagctgaaatcattgagaactaccagggacgagatgctactgacgccttcatggttatgcactctcaggaagccttcgacaagctcaagcgaatgcccaagatcaaccaggcttccgagctgcctccccaggctgccgtcaacgaagctcaggaggatttccgaaagctccgagaagagctgatcgccactggcatgtttgacgcctctcccctctggtactcgtacaagatcttgaccaccctgggtcttggcgtgcttgccttcttcatgctggtccagtaccacctgtacttcattggtgctctcgtgctcggtatgcactaccagcaaatgggatggctgtctcatgacatctgccaccaccagaccttcaagaaccgaaactggaataacgtcctgggtctggtctttggcaacggactccagggcttctccgtgacctggtggaaggacagacacaacgcccatcattctgctaccaacgttcagggtcacgatcccgacattgataacctgcctctgctcgcctggtccgaggacgatgtcactcgagcttctcccatctcccgaaagctcattcagttccaacagtactatttcctggtcatctgtattctcctgcgattcatctggtgtttccagtctgtgctgaccgttcgatccctcaaggaccgagacaaccagttctaccgatctcagtacaagaaagaggccattggactcgctctgcactggactctcaagaccctgttccacctcttctttatgccctccatcctgacctcgatgctggtgttctttgtttccgagctcgtcggtggcttcggaattgccatcgtggtcttcatgaaccactaccctctggagaagatcggtgattccgtctgggacggacatggcttctctgtgggtcagatccatgagaccatgaacattcgacgaggcatcattactgactggttctttggaggcctgaactaccagatcgagcaccatctctggcccaccctgcctcgacacaacctcactgccgtttcctaccaggtggaacagctgtgccagaagcacaacctcccctaccgaaaccctctgccccatgaaggtctcgtcatcctgctccgatacctgtcccagttcgctcgaatggccgagaagcagcccggtgccaaggctcagtaa

SEQ ID NO: 447 - protein, 703 aa, Artificial Sequence
  Synthetic Construct
MEVVNEIVSIGQEVLPKVDYAQLWSDASHCEVLYLSIAFVILKFTLGPLGPKGQSRMKFVFTNYNLLMSIYSLGSFLSMAYAMYTIGVMSDNCEKAFDNNVFRITTQLFYLSKFLEYIDSFYLPLMGKPLTWLQFFHHLGAPMDMWLFYNYRNEAVWIFVLLNGFIHWIMYGYYWTRLIKLKFPMPKSLITSMQIIQFNVGFYIVWKYRNIPCYRQDGMRMFGWFFNYFYVGTVLCLFLNFYVQTYIVRKHKGAKKIQGAGPARPAGLPPATYYDSLAVMGSVKASRQALPLVIDGKVYDVSAWVNFHPGGAEIIENYQGRDATDAFMVMHSQEAFDKLKRMPKINQASELPPQAAVNEAQEDFRKLREELIATGMFDASPLWYSYKILTTLGLGVLAFFMLVQYHLYFIGALVLGMHYQQMGWLSHDICHHQTFKNRNWNNVLGLVFGNGLQGFSVTWWKDRHNAHHSATNVQGHDPDIDNLPLLAWSEDDVTRASPISRKLIQFQQYYFLVICILLRFIWCFQSVLTVRSLKDRDNQFYRSQYKKEAIGLALHWTLKTLFHLFFMPSILTSMLVFFVSELVGGFGIAIVVFMNHYPLEKIGDSVWDGHGFSVGQIHETMNIRRGIITDWFFGGLNYQIEHHLWPTLPRHNLTAVSYQVEQLCQKHNLPYRNPLPHEGLVILLRYLSQFARMAEKQPGAKAQ

SEQ ID NO: 448 - DNA, 3988 bp, Artificial Sequence
  Plasmid pEaD8S
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacctcgcgaatgcatctagatccaatccatggtcaagcgacccgctctgcctctcaccgtggacggtgtcacctacgacgtttctgcctggctcaaccaccatcccggaggtgccgacattatcgagaactaccgaggtcgggatgctaccgacgtcttcatggttatgcactccgagaacgccgtgtccaaactcagacgaatgcccatcatggaaccttcctctcccctgactccaacacctcccaagccaaactccgacgaacctcaggaggatttccgaaagctgcgagacgagctcattgctgcaggcatgttcgatgcctctcccatgtggtacgcttacaagaccctgtcgactctcggactgggtgtccttgccgtgctgttgatgacccagtggcactggtacctggttggtgctatcgtcctcggcattcactttcaacagatgggatggctctcgcacgacatttgccatcaccagctgttcaaggaccgatccatcaacaatgccattggcctgctcttcggaaacgtgcttcagggcttttctgtcacttggtggaaggaccgacacaacgctcatcactccgccaccaacgtgcagggtcacgatcccgacatcgacaacctgcctctcctggcgtggtccaaggaggacgtcgagcgagctggcccgttttctcgacggatgatcaagtaccaacagtattacttctttttcatctgtgcccttctgcgattcatctggtgctttcagtccattcatactgccacgggtctcaaggatcgaagcaatcagtactatcgaagacagtacgagaaggagtccgtcggtctggcactccactggggtctcaaggccttgttctactatttctacatgccctcgtttctcaccggactcatggtgttctttgtctccgagctgcttggtggcttcggaattgccatcgttgtcttcatgaaccactaccctctggagaagattcaggactccgtgtgggatggtcatggcttctgtgctggacagattcacgagaccatgaacgttcagcgaggcctcgtcacagactggtttttcggtggcctcaactaccagatcgaacatcacctgtggcctactcttcccagacacaacctcaccgctgcctccatcaaagtggagcagctgtgcaagaagcacaacctgccctaccgatctcctcccatgctcgaaggtgtcggcattcttatctcctacctgggcaccttcgctcgaatggttgccaaggcagacaaggcctaagcggccgcatcggatcccgggcccgtcgactgcagaggcctgcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 449 - DNA, 35 bp, Artificial Sequence
  Primer YL1059
gaatgcatctagatccaggatccatggtcaagcga

SEQ ID NO: 450 - DNA, 35 bp, Artificial Sequence
  Primer YL1060
tcgcttgaccatggatcctggatctagatgcattc

SEQ ID NO: 451 - DNA, 3990 bp, Artificial Sequence
  Plasmid pEaD8S-B
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacctcgcgaatgcatctagatccaggatccatggtcaagcgacccgctctgcctctcaccgtggacggtgtcacctacgacgtttctgcctggctcaaccaccatcccggaggtgccgacattatcgagaactaccgaggtcgggatgctaccgacgtcttcatggttatgcactccgagaacgccgtgtccaaactcagacgaatgcccatcatggaaccttcctctcccctgactccaacacctcccaagccaaactccgacgaacctcaggaggatttccgaaagctgcgagacgagctcattgctgcaggcatgttcgatgcctctcccatgtggtacgcttacaagaccctgtcgactctcggactgggtgtccttgccgtgctgttgatgacccagtggcactggtacctggttggtgctatcgtcctcggcattcactttcaacagatgggatggctctcgcacgacatttgccatcaccagctgttcaaggaccgatccatcaacaatgccattggcctgctcttcggaaacgtgcttcagggcttttctgtcacttggtggaaggaccgacacaacgctcatcactccgccaccaacgtgcagggtcacgatcccgacatcgacaacctgcctctcctggcgtggtccaaggaggacgtcgagcgagctggcccgttttctcgacggatgatcaagtaccaacagtattacttctttttcatctgtgcccttctgcgattcatctggtgctttcagtccattcatactgccacgggtctcaaggatcgaagcaatcagtactatcgaagacagtacgagaaggagtccgtcggtctggcactccactggggtctcaaggccttgttctactatttctacatgccctcgtttctcaccggactcatggtgttctttgtctccgagctgcttggtggcttcggaattgccatcgttgtcttcatgaaccactaccctctggagaagattcaggactccgtgtgggatggtcatggcttctgtgctggacagattcacgagaccatgaacgttcagcgaggcctcgtcacagactggtttttcggtggcctcaactaccagatcgaacatcacctgtggcctactcttcccagacacaacctcaccgctgcctccatcaaagtggagcagctgtgcaagaagcacaacctgccctaccgatctcctcccatgctcgaaggtgtcggcattcttatctcctacctgggcaccttcgctcgaatggttgccaaggcagacaaggcctaagcggccgcatcggatcccgggcccgtcgactgcagaggcctgcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 452 - DNA, 9101 bp, Artificial Sequence
  Plasmid pZUFmG9A8
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggaggtcgtgaacgaaatcgtctccattggccaggaggttcttcccaaggtcgactatgctcagctctggtctgatgcctcgcactgcgaggtgctgtacctctccatcgccttcgtcatcctgaagttcacccttggtcctctcggacccaagggtcagtctcgaatgaagtttgtgttcaccaactacaacctgctcatgtccatctactcgctgggctccttcctctctatggcctacgccatgtacaccattggtgtcatgtccgacaactgcgagaaggctttcgacaacaatgtcttccgaatcaccactcagctgttctacctcagcaagttcctcgagtacattgactccttctatctgcccctcatgggcaagcctctgacctggttgcagttctttcaccatctcggagctcctatggacatgtggctgttctacaactaccgaaacgaagccgtttggatctttgtgctgctcaacggcttcattcactggatcatgtacggctactattggacccgactgatcaagctcaagttccctatgcccaagtccctgattacttctatgcagatcattcagttcaacgttggcttctacatcgtctggaagtaccggaacattccctgctaccgacaagatggaatgagaatgtttggctggtttttcaactacttctacgttggtactgtcctgtgtctgttcctcaacttctacgtgcagacctacatcgtccgaaagcacaagggagccaaaaagattcagggcgccggtcccgctcgacctgccggacttcctcccgctacctactacgactctctggccgtcatgggatccatggtcaagcgacccgctctgcctctcaccgtggacggtgtcacctacgacgtttctgcctggctcaaccaccatcccggaggtgccgacattatcgagaactaccgaggtcgggatgctaccgacgtcttcatggttatgcactccgagaacgccgtgtccaaactcagacgaatgcccatcatggaaccttcctctcccctgactccaacacctcccaagccaaactccgacgaacctcaggaggatttccgaaagctgcgagacgagctcattgctgcaggcatgttcgatgcctctcccatgtggtacgcttacaagaccctgtcgactctcggactgggtgtccttgccgtgctgttgatgacccagtggcactggtacctggttggtgctatcgtcctcggcattcactttcaacagatgggatggctctcgcacgacatttgccatcaccagctgttcaaggaccgatccatcaacaatgccattggcctgctcttcggaaacgtgcttcagggcttttctgtcacttggtggaaggaccgacacaacgctcatcactccgccaccaacgtgcagggtcacgatcccgacatcgacaacctgcctctcctggcgtggtccaaggaggacgtcgagcgagctggcccgttttctcgacggatgatcaagtaccaacagtattacttctttttcatctgtgcccttctgcgattcatctggtgctttcagtccattcatactgccacgggtctcaaggatcgaagcaatcagtactatcgaagacagtacgagaaggagtccgtcggtctggcactccactggggtctcaaggccttgttctactatttctacatgccctcgtttctcaccggactcatggtgttctttgtctccgagctgcttggtggcttcggaattgccatcgttgtcttcatgaaccactaccctctggagaagattcaggactccgtgtgggatggtcatggcttctgtgctggacagattcacgagaccatgaacgttcagcgaggcctcgtcacagactggtttttcggtggcctcaactaccagatcgaacatcacctgtggcctactcttcccagacacaacctcaccgctgcctccatcaaagtggagcagctgtgcaagaagcacaacctgccctaccgatctcctcccatgctcgaaggtgtcggcattcttatctcctacctgggcaccttcgctcgaatggttgccaaggcagacaaggcctaagc

SEQ ID NO: 453 - DNA, 2109 bp, Artificial Sequence
  Multizyme: EgD9ES/EaD8S gene fusion
  CDS (1)..(2109): Multizyme: EgD9ES/EaD8S gene fusion
atggaggtcgtgaacgaaatcgtctccattggccaggaggttcttcccaaggtcgactatgctcagctctggtctgatgcctcgcactgcgaggtgctgtacctctccatcgccttcgtcatcctgaagttcacccttggtcctctcggacccaagggtcagtctcgaatgaagtttgtgttcaccaactacaacctgctcatgtccatctactcgctgggctccttcctctctatggcctacgccatgtacaccattggtgtcatgtccgacaactgcgagaaggctttcgacaacaatgtcttccgaatcaccactcagctgttctacctcagcaagttcctcgagtacattgactccttctatctgcccctcatgggcaagcctctgacctggttgcagttctttcaccatctcggagctcctatggacatgtggctgttctacaactaccgaaacgaagccgtttggatctttgtgctgctcaacggcttcattcactggatcatgtacggctactattggacccgactgatcaagctcaagttccctatgcccaagtccctgattacttctatgcagatcattcagttcaacgttggcttctacatcgtctggaagtaccggaacattccctgctaccgacaagatggaatgagaatgtttggctggtttttcaactacttctacgttggtactgtcctgtgtctgttcctcaacttctacgtgcagacctacatcgtccgaaagcacaagggagccaaaaagattcagggcgccggtcccgctcgacctgccggacttcctcccgctacctactacgactctctggccgtcatgggatccatggtcaagcgacccgctctgcctctcaccgtggacggtgtcacctacgacgtttctgcctggctcaaccaccatcccggaggtgccgacattatcgagaactaccgaggtcgggatgctaccgacgtcttcatggttatgcactccgagaacgccgtgtccaaactcagacgaatgcccatcatggaaccttcctctcccctgactccaacacctcccaagccaaactccgacgaacctcaggaggatttccgaaagctgcgagacgagctcattgctgcaggcatgttcgatgcctctcccatgtggtacgcttacaagaccctgtcgactctcggactgggtgtccttgccgtgctgttgatgacccagtggcactggtacctggttggtgctatcgtcctcggcattcactttcaacagatgggatggctctcgcacgacatttgccatcaccagctgttcaaggaccgatccatcaacaatgccattggcctgctcttcggaaacgtgcttcagggcttttctgtcacttggtggaaggaccgacacaacgctcatcactccgccaccaacgtgcagggtcacgatcccgacatcgacaacctgcctctcctggcgtggtccaaggaggacgtcgagcgagctggcccgttttctcgacggatgatcaagtaccaacagtattacttctttttcatctgtgcccttctgcgattcatctggtgctttcagtccattcatactgccacgggtctcaaggatcgaagcaatcagtactatcgaagacagtacgagaaggagtccgtcggtctggcactccactggggtctcaaggccttgttctactatttctacatgccctcgtttctcaccggactcatggtgttctttgtctccgagctgcttggtggcttcggaattgccatcgttgtcttcatgaaccactaccctctggagaagattcaggactccgtgtgggatggtcatggcttctgtgctggacagattcacgagaccatgaacgttcagcgaggcctcgtcacagactggtttttcggtggcctcaactaccagatcgaacatcacctgtggcctactcttcccagacacaacctcaccgctgcctccatcaaagtggagcagctgtgcaagaagcacaacctgccctaccgatctcctcccatgctcgaaggtgtcggcattcttatctcctacctgggcaccttcgctcgaatggttgccaaggcagacaaggcctaa

SEQ ID NO: 454 - protein, 702 aa, Artificial Sequence
  Synthetic Construct
MEVVNEIVSIGQEVLPKVDYAQLWSDASHCEVLYLSIAFVILKFTLGPLGPKGQSRMKFVFTNYNLLMSIYSLGSFLSMAYAMYTIGVMSDNCEKAFDNNVFRITTQLFYLSKFLEYIDSFYLPLMGKPLTWLQFFHHLGAPMDMWLFYNYRNEAVWIFVLLNGFIHWIMYGYYWTRLIKLKFPMPKSLITSMQIIQFNVGFYIVWKYRNIPCYRQDGMRMFGWFFNYFYVGTVLCLFLNFYVQTYIVRKHKGAKKIQGAGPARPAGLPPATYYDSLAVMGSMVKRPALPLTVDGVTYDVSAWLNHHPGGADIIENYRGRDATDVFMVMHSENAVSKLRRMPIMEPSSPLTPTPPKPNSDEPQEDFRKLRDELIAAGMFDASPMWYAYKTLSTLGLGVLAVLLMTQWHWYLVGAIVLGIHFQQMGWLSHDICHHQLFKDRSINNAIGLLFGNVLQGFSVTWWKDRHNAHHSATNVQGHDPDIDNLPLLAWSKEDVERAGPFSRRMIKYQQYYFFFICALLRFIWCFQSIHTATGLKDRSNQYYRRQYEKESVGLALHWGLKALFYYFYMPSFLTGLMVFFVSELLGGFGIAIVVFMNHYPLEKIQDSVWDGHGFCAGQIHETMNVQRGLVTDWFFGGLNYQIEHHLWPTLPRHNLTAASIKVEQLCKKHNLPYRSPPMLEGVGILISYLGTFARMVAKADKA

SEQ ID NO: 455 - DNA, 7769 bp, Artificial Sequence
  Plasmid pZUFmEaD9ES
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggaggctgccaaggagctggtctccatcgtccaggaggaacttcccaaggtggactacgcccagctctggcaggacgcctcctcttgcgaggttctgtacctctcggtcgctttcgtggccatcaagttcatgcttcgacctctggacctcaagcgacaagccaccctcaaaaagctgttcaccgcatacaactttctcatgtccatctactcgttcggctccttcctggcgatggcctacgctctctctgtcactggtattctttccggcgattgtgagactgccttcaacaatgacgtgttccgaatcaccactcagctgttctacctcagcaagttcgtcgagtacatcgactccttctaccttcccctcatggacaagcccttgtcgtttctgcagttctttcaccatctcggagctcccatcgacatgtggctgttctacaagtatcgaaacgaaggcgtctggatctttgttctgctcaacggcttcattcactggatcatgtacggttactattggacgcgactcatcaagctgaacttccctatgcccaagaacctcattacctccatgcaaattatccagttcaacgtcggattctacatcgtctggaagtaccgaaacgtgccctgctaccggcaggacggtatgcgaatgtttgcctggatcttcaactactggtatgtcggcacggtgctgcttctgttcctcaacttctacgtccagacctacattcggaagcctcgaaagaaccgaggcaaaaaggagtaagc

SEQ ID NO: 456 - DNA, 7775 bp, Artificial Sequence
  Plasmid pZUFmEaD9ES-Na
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggaggctgccaaggagctggtctccatcgtccaggaggaacttcccaaggtggactacgcccagctctggcaggacgcctcctcttgcgaggttctgtacctctcggtcgctttcgtggccatcaagttcatgcttcgacctctggacctcaagcgacaagccaccctcaaaaagctgttcaccgcatacaactttctcatgtccatctactcgttcggctccttcctggcgatggcctacgctctctctgtcactggtattctttccggcgattgtgagactgccttcaacaatgacgtgttccgaatcaccactcagctgttctacctcagcaagttcgtcgagtacatcgactccttctaccttcccctcatggacaagcccttgtcgtttctgcagttctttcaccatctcggagctcccatcgacatgtggctgttctacaagtatcgaaacgaaggcgtctggatctttgttctgctcaacggcttcattcactggatcatgtacggttactattggacgcgactcatcaagctgaacttccctatgcccaagaacctcattacctccatgcaaattatccagttcaacgtcggattctacatcgtctggaagtaccgaaacgtgccctgctaccggcaggacggtatgcgaatgtttgcctggatcttcaactactggtatgtcggcacggtgctgcttctgttcctcaacttctacgtccagacctacattcggaagcctcgaaagaaccgaggcaaaaaggagggcgcctaagc

SEQ ID NO: 457 - DNA, 42 bp, Artificial Sequence
  Primer YL1049
aaccgaggcaaaaaggagggcgcctaagcggccgcaagtgtg

SEQ ID NO: 458 - DNA, 42 bp, Artificial Sequence
  Primer YL1050
cacacttgcggccgcttaggcgccctcctttttgcctcggtt

SEQ ID NO: 459 - DNA, 9104 bp, Artificial Sequence
  Plasmid pZUFmA9G8
cgccggtcccgctcgacctgccggacttcctcccgctacctactacgactctctggccgtcatgggatccgtgaaggcttctcgacaggctctgcccctcgtcatcgacggaaaggtgtacgacgtctccgcttgggtgaacttccaccctggtggagctgaaatcattgagaactaccagggacgagatgctactgacgccttcatggttatgcactctcaggaagccttcgacaagctcaagcgaatgcccaagatcaaccaggcttccgagctgcctccccaggctgccgtcaacgaagctcaggaggatttccgaaagctccgagaagagctgatcgccactggcatgtttgacgcctctcccctctggtactcgtacaagatcttgaccaccctgggtcttggcgtgcttgccttcttcatgctggtccagtaccacctgtacttcattggtgctctcgtgctcggtatgcactaccagcaaatgggatggctgtctcatgacatctgccaccaccagaccttcaagaaccgaaactggaataacgtcctgggtctggtctttggcaacggactccagggcttctccgtgacctggtggaaggacagacacaacgcccatcattctgctaccaacgttcagggtcacgatcccgacattgataacctgcctctgctcgcctggtccgaggacgatgtcactcgagcttctcccatctcccgaaagctcattcagttccaacagtactatttcctggtcatctgtattctcctgcgattcatctggtgtttccagtctgtgctgaccgttcgatccctcaaggaccgagacaaccagttctaccgatctcagtacaagaaagaggccattggactcgctctgcactggactctcaagaccctgttccacctcttctttatgccctccatcctgacctcgatgctggtgttctttgtttccgagctcgtcggtggcttcggaattgccatcgtggtcttcatgaaccactaccctctggagaagatcggtgattccgtctgggacggacatggcttctctgtgggtcagatccatgagaccatgaacattcgacgaggcatcattactgactggttctttggaggcctgaactaccagatcgagcaccatctctggcccaccctgcctcgacacaacctcactgccgtttcctaccaggtggaacagctgtgccagaagcacaacctcccctaccgaaaccctctgccccatgaaggtctcgtcatcctgctccgatacctgtcccagttcgctcgaatggccgagaagcagcccggtgccaaggctcagtaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggaggctgccaaggagctggtctccatcgtccaggaggaacttcccaaggtggactacgcccagctctggcaggacgcctcctcttgcgaggttctgtacctctcggtcgctttcgtggccatcaagttcatgcttcgacctctggacctcaagcgacaagccaccctcaaaaagctgttcaccgcatacaactttctcatgtccatctactcgttcggctccttcctggcgatggcctacgctctctctgtcactggtattctttccggcgattgtgagactgccttcaacaatgacgtgttccgaatcaccactcagctgttctacctcagcaagttcgtcgagtacatcgactccttctaccttcccctcatggacaagcccttgtcgtttctgcagttctttcaccatctcggagctcccatcgacatgtggctgttctacaagtatcgaaacgaaggcgtctggatctttgttctgctcaacggcttcattcactggatcatgtacggttactattggacgcgactcatcaagctgaacttccctatgcccaagaacctcattacctccatgcaaattatccagttcaacgtcggattctacatcgtctggaagtaccgaaacgtgccctgctaccggcaggacggtatgcgaatgtttgcctggatcttcaactactggtatgtcggcacggtgctgcttctgttcctcaacttctacgtccagacctacattcggaagcctcgaaagaaccgaggcaaaaaggaggg

SEQ ID NO: 460 - DNA, 2112 bp, Artificial Sequence
  Multizyme: EaD9ES/EgD8M gene fusion
  CDS (1)..(2112): Multizyme: EaD9ES/EgD8M gene fusion
atggaggctgccaaggagctggtctccatcgtccaggaggaacttcccaaggtggactacgcccagctctggcaggacgcctcctcttgcgaggttctgtacctctcggtcgctttcgtggccatcaagttcatgcttcgacctctggacctcaagcgacaagccaccctcaaaaagctgttcaccgcatacaactttctcatgtccatctactcgttcggctccttcctggcgatggcctacgctctctctgtcactggtattctttccggcgattgtgagactgccttcaacaatgacgtgttccgaatcaccactcagctgttctacctcagcaagttcgtcgagtacatcgactccttctaccttcccctcatggacaagcccttgtcgtttctgcagttctttcaccatctcggagctcccatcgacatgtggctgttctacaagtatcgaaacgaaggcgtctggatctttgttctgctcaacggcttcattcactggatcatgtacggttactattggacgcgactcatcaagctgaacttccctatgcccaagaacctcattacctccatgcaaattatccagttcaacgtcggattctacatcgtctggaagtaccgaaacgtgccctgctaccggcaggacggtatgcgaatgtttgcctggatcttcaactactggtatgtcggcacggtgctgcttctgttcctcaacttctacgtccagacctacattcggaagcctcgaaagaaccgaggcaaaaaggagggcgccggtcccgctcgacctgccggacttcctcccgctacctactacgactctctggccgtcatgggatccgtgaaggcttctcgacaggctctgcccctcgtcatcgacggaaaggtgtacgacgtctccgcttgggtgaacttccaccctggtggagctgaaatcattgagaactaccagggacgagatgctactgacgccttcatggttatgcactctcaggaagccttcgacaagctcaagcgaatgcccaagatcaaccaggcttccgagctgcctccccaggctgccgtcaacgaagctcaggaggatttccgaaagctccgagaagagctgatcgccactggcatgtttgacgcctctcccctctggtactcgtacaagatcttgaccaccctgggtcttggcgtgcttgccttcttcatgctggtccagtaccacctgtacttcattggtgctctcgtgctcggtatgcactaccagcaaatgggatggctgtctcatgacatctgccaccaccagaccttcaagaaccgaaactggaataacgtcctgggtctggtctttggcaacggactccagggcttctccgtgacctggtggaaggacagacacaacgcccatcattctgctaccaacgttcagggtcacgatcccgacattgataacctgcctctgctcgcctggtccgaggacgatgtcactcgagcttctcccatctcccgaaagctcattcagttccaacagtactatttcctggtcatctgtattctcctgcgattcatctggtgtttccagtctgtgctgaccgttcgatccctcaaggaccgagacaaccagttctaccgatctcagtacaagaaagaggccattggactcgctctgcactggactctcaagaccctgttccacctcttctttatgccctccatcctgacctcgatgctggtgttctttgtttccgagctcgtcggtggcttcggaattgccatcgtggtcttcatgaaccactaccctctggagaagatcggtgattccgtctgggacggacatggcttctctgtgggtcagatccatgagaccatgaacattcgacgaggcatcattactgactggttctttggaggcctgaactaccagatcgagcaccatctctggcccaccctgcctcgacacaacctcactgccgtttcctaccaggtggaacagctgtgccagaagcacaacctcccctaccgaaaccctctgccccatgaaggtctcgtcatcctgctccgatacctgtcccagttcgctcgaatggccgagaagcagcccggtgccaaggctcagtaa

SEQ ID NO: 461 - protein, 703 aa, Artificial Sequence
  Synthetic Construct
MEAAKELVSIVQEELPKVDYAQLWQDASSCEVLYLSVAFVAIKFMLRPLDLKRQATLKKLFTAYNFLMSIYSFGSFLAMAYALSVTGILSGDCETAFNNDVFRITTQLFYLSKFVEYIDSFYLPLMDKPLSFLQFFHHLGAPIDMWLFYKYRNEGVWIFVLLNGFIHWIMYGYYWTRLIKLNFPMPKNLITSMQIIQFNVGFYIVWKYRNVPCYRQDGMRMFAWIFNYWYVGTVLLLFLNFYVQTYIRKPRKNRGKKEGAGPARPAGLPPATYYDSLAVMGSVKASRQALPLVIDGKVYDVSAWVNFHPGGAEIIENYQGRDATDAFMVMHSQEAFDKLKRMPKINQASELPPQAAVNEAQEDFRKLREELIATGMFDASPLWYSYKILTTLGLGVLAFFMLVQYHLYFIGALVLGMHYQQMGWLSHDICHHQTFKNRNWNNVLGLVFGNGLQGFSVTWWKDRHNAHHSATNVQGHDPDIDNLPLLAWSEDDVTRASPISRKLIQFQQYYFLVICILLRFIWCFQSVLTVRSLKDRDNQFYRSQYKKEAIGLALHWTLKTLFHLFFMPSILTSMLVFFVSELVGGFGIAIVVFMNHYPLEKIGDSVWDGHGFSVGQIHETMNIRRGIITDWFFGGLNYQIEHHLWPTLPRHNLTAVSYQVEQLCQKHNLPYRNPLPHEGLVILLRYLSQFARMAEKQPGAKAQ

SEQ ID NO: 462 - DNA, 9101 bp, Artificial Sequence
  Plasmid pZUFmA9A8
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggaggctgccaaggagctggtctccatcgtccaggaggaacttcccaaggtggactacgcccagctctggcaggacgcctcctcttgcgaggttctgtacctctcggtcgctttcgtggccatcaagttcatgcttcgacctctggacctcaagcgacaagccaccctcaaaaagctgttcaccgcatacaactttctcatgtccatctactcgttcggctccttcctggcgatggcctacgctctctctgtcactggtattctttccggcgattgtgagactgccttcaacaatgacgtgttccgaatcaccactcagctgttctacctcagcaagttcgtcgagtacatcgactccttctaccttcccctcatggacaagcccttgtcgtttctgcagttctttcaccatctcggagctcccatcgacatgtggctgttctacaagtatcgaaacgaaggcgtctggatctttgttctgctcaacggcttcattcactggatcatgtacggttactattggacgcgactcatcaagctgaacttccctatgcccaagaacctcattacctccatgcaaattatccagttcaacgtcggattctacatcgtctggaagtaccgaaacgtgccctgctaccggcaggacggtatgcgaatgtttgcctggatcttcaactactggtatgtcggcacggtgctgcttctgttcctcaacttctacgtccagacctacattcggaagcctcgaaagaaccgaggcaaaaaggagggcgccggtcccgctcgacctgccggacttcctcccgctacctactacgactctctggccgtcatgggatccatggtcaagcgacccgctctgcctctcaccgtggacggtgtcacctacgacgtttctgcctggctcaaccaccatcccggaggtgccgacattatcgagaactaccgaggtcgggatgctaccgacgtcttcatggttatgcactccgagaacgccgtgtccaaactcagacgaatgcccatcatggaaccttcctctcccctgactccaacacctcccaagccaaactccgacgaacctcaggaggatttccgaaagctgcgagacgagctcattgctgcaggcatgttcgatgcctctcccatgtggtacgcttacaagaccctgtcgactctcggactgggtgtccttgccgtgctgttgatgacccagtggcactggtacctggttggtgctatcgtcctcggcattcactttcaacagatgggatggctctcgcacgacatttgccatcaccagctgttcaaggaccgatccatcaacaatgccattggcctgctcttcggaaacgtgcttcagggcttttctgtcacttggtggaaggaccgacacaacgctcatcactccgccaccaacgtgcagggtcacgatcccgacatcgacaacctgcctctcctggcgtggtccaaggaggacgtcgagcgagctggcccgttttctcgacggatgatcaagtaccaacagtattacttctttttcatctgtgcccttctgcgattcatctggtgctttcagtccattcatactgccacgggtctcaaggatcgaagcaatcagtactatcgaagacagtacgagaaggagtccgtcggtctggcactccactggggtctcaaggccttgttctactatttctacatgccctcgtttctcaccggactcatggtgttctttgtctccgagctgcttggtggcttcggaattgccatcgttgtcttcatgaaccactaccctctggagaagattcaggactccgtgtgggatggtcatggcttctgtgctggacagattcacgagaccatgaacgttcagcgaggcctcgtcacagactggtttttcggtggcctcaactaccagatcgaacatcacctgtggcctactcttcccagacacaacctcaccgctgcctccatcaaagtggagcagctgtgcaagaagcacaacctgccctaccgatctcctcccatgctcgaaggtgtcggcattcttatctcctacctgggcaccttcgctcgaatggttgccaaggcagacaaggcctaagc

SEQ ID NO: 463 - DNA, 2109 bp, Artificial Sequence
  Multizyme: EaD9ES/EaD8S gene fusion
  CDS (1)..(2109): Multizyme: EaD9ES/EaD8S gene fusion
atggaggctgccaaggagctggtctccatcgtccaggaggaacttcccaaggtggactacgcccagctctggcaggacgcctcctcttgcgaggttctgtacctctcggtcgctttcgtggccatcaagttcatgcttcgacctctggacctcaagcgacaagccaccctcaaaaagctgttcaccgcatacaactttctcatgtccatctactcgttcggctccttcctggcgatggcctacgctctctctgtcactggtattctttccggcgattgtgagactgccttcaacaatgacgtgttccgaatcaccactcagctgttctacctcagcaagttcgtcgagtacatcgactccttctaccttcccctcatggacaagcccttgtcgtttctgcagttctttcaccatctcggagctcccatcgacatgtggctgttctacaagtatcgaaacgaaggcgtctggatctttgttctgctcaacggcttcattcactggatcatgtacggttactattggacgcgactcatcaagctgaacttccctatgcccaagaacctcattacctccatgcaaattatccagttcaacgtcggattctacatcgtctggaagtaccgaaacgtgccctgctaccggcaggacggtatgcgaatgtttgcctggatcttcaactactggtatgtcggcacggtgctgcttctgttcctcaacttctacgtccagacctacattcggaagcctcgaaagaaccgaggcaaaaaggagggcgccggtcccgctcgacctgccggacttcctcccgctacctactacgactctctggccgtcatgggatccatggtcaagcgacccgctctgcctctcaccgtggacggtgtcacctacgacgtttctgcctggctcaaccaccatcccggaggtgccgacattatcgagaactaccgaggtcgggatgctaccgacgtcttcatggttatgcactccgagaacgccgtgtccaaactcagacgaatgcccatcatggaaccttcctctcccctgactccaacacctcccaagccaaactccgacgaacctcaggaggatttccgaaagctgcgagacgagctcattgctgcaggcatgttcgatgcctctcccatgtggtacgcttacaagaccctgtcgactctcggactgggtgtccttgccgtgctgttgatgacccagtggcactggtacctggttggtgctatcgtcctcggcattcactttcaacagatgggatggctctcgcacgacatttgccatcaccagctgttcaaggaccgatccatcaacaatgccattggcctgctcttcggaaacgtgcttcagggcttttctgtcacttggtggaaggaccgacacaacgctcatcactccgccaccaacgtgcagggtcacgatcccgacatcgacaacctgcctctcctggcgtggtccaaggaggacgtcgagcgagctggcccgttttctcgacggatgatcaagtaccaacagtattacttctttttcatctgtgcccttctgcgattcatctggtgctttcagtccattcatactgccacgggtctcaaggatcgaagcaatcagtactatcgaagacagtacgagaaggagtccgtcggtctggcactccactggggtctcaaggccttgttctactatttctacatgccctcgtttctcaccggactcatggtgttctttgtctccgagctgcttggtggcttcggaattgccatcgttgtcttcatgaaccactaccctctggagaagattcaggactccgtgtgggatggtcatggcttctgtgctggacagattcacgagaccatgaacgttcagcgaggcctcgtcacagactggtttttcggtggcctcaactaccagatcgaacatcacctgtggcctactcttcccagacacaacctcaccgctgcctccatcaaagtggagcagctgtgcaagaagcacaacctgccctaccgatctcctcccatgctcgaaggtgtcggcattcttatctcctacctgggcaccttcgctcgaatggttgccaaggcagacaaggcctaa

SEQ ID NO: 464 - protein, 702 aa, Artificial Sequence
  Synthetic Construct
MEAAKELVSIVQEELPKVDYAQLWQDASSCEVLYLSVAFVAIKFMLRPLDLKRQATLKKLFTAYNFLMSIYSFGSFLAMAYALSVTGILSGDCETAFNNDVFRITTQLFYLSKFVEYIDSFYLPLMDKPLSFLQFFHHLGAPIDMWLFYKYRNEGVWIFVLLNGFIHWIMYGYYWTRLIKLNFPMPKNLITSMQIIQFNVGFYIVWKYRNVPCYRQDGMRMFAWIFNYWYVGTVLLLFLNFYVQTYIRKPRKNRGKKEGAGPARPAGLPPATYYDSLAVMGSMVKRPALPLTVDGVTYDVSAWLNHHPGGADIIENYRGRDATDVFMVMHSENAVSKLRRMPIMEPSSPLTPTPPKPNSDEPQEDFRKLRDELIAAGMFDASPMWYAYKTLSTLGLGVLAVLLMTQWHWYLVGAIVLGIHFQQMGWLSHDICHHQLFKDRSINNAIGLLFGNVLQGFSVTWWKDRHNAHHSATNVQGHDPDIDNLPLLAWSKEDVERAGPFSRRMIKYQQYYFFFICALLRFIWCFQSIHTATGLKDRSNQYYRRQYEKESVGLALHWGLKALFYYFYMPSFLTGLMVFFVSELLGGFGIAIVVFMNHYPLEKIQDSVWDGHGFCAGQIHETMNVQRGLVTDWFFGGLNYQIEHHLWPTLPRHNLTAASIKVEQLCKKHNLPYRSPPMLEGVGILISYLGTFARMVAKADKA

SEQ ID NO: 465 - DNA, 3523 bp, Artificial Sequence
  Plasmid pE389S
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacctcgcgaatgcatctagataattgggcggccgctactggacctttttgtcggcagtcttaggcttgggaaacacgtaggacttgacaaagaagttgatgaagagcagaagaacggtaccgacgtaccagtagttgaagatccaggccagcattcgcatgggatcctttcggtaacagggaatgtccttgtaccaccacacgaggtagaagccaacgttgaactgggtgatctgcattgcggtaatgagctgcttgggcatgggaaagttgaacttcatcagccgtgtccaatagtagccgtacatgacaaagtgaatgaatccgttcaggaacacaaagatccaaatggattcgccagagtactgcacgaagagccacatgtccataggagctcccaagtgatgaaagaactgcagaaaggacagaggcttggccatgaggggaaggtagaaagagtcgatgtactccagaaacttggaatagtagaagaccttggtggcaaatcggaacaagctgttgtcgaaagctctgtcgcattcgttggagtacagtccaacggtgtagatggcgtaacccatacagaggaaggacaccagcgaaaagacggacatgaagaggttgtaccacttgaacagcactcgcagaatctttttgccagaatccgagagctcgccaagggtaaacttgaggatgacgaaagcaatggagaagtacaggagctcgcaggagtagatgtctcgccagagtcgctgatagtccaccttgggaagggtctcggcagtgatagcgacgaactcgttggccacctcgatgacggcagccatggaattggatcggatcccgggcccgtcgactgcagaggcctgcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 466 - DNA, 3529 bp, Artificial Sequence
  Plasmid pE389S-Na
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacctcgcgaatgcatctagataattgggcggccgctaggcgccctggacctttttgtcggcagtcttaggcttgggaaacacgtaggacttgacaaagaagttgatgaagagcagaagaacggtaccgacgtaccagtagttgaagatccaggccagcattcgcatgggatcctttcggtaacagggaatgtccttgtaccaccacacgaggtagaagccaacgttgaactgggtgatctgcattgcggtaatgagctgcttgggcatgggaaagttgaacttcatcagccgtgtccaatagtagccgtacatgacaaagtgaatgaatccgttcaggaacacaaagatccaaatggattcgccagagtactgcacgaagagccacatgtccataggagctcccaagtgatgaaagaactgcagaaaggacagaggcttggccatgaggggaaggtagaaagagtcgatgtactccagaaacttggaatagtagaagaccttggtggcaaatcggaacaagctgttgtcgaaagctctgtcgcattcgttggagtacagtccaacggtgtagatggcgtaacccatacagaggaaggacaccagcgaaaagacggacatgaagaggttgtaccacttgaacagcactcgcagaatctttttgccagaatccgagagctcgccaagggtaaacttgaggatgacgaaagcaatggagaagtacaggagctcgcaggagtagatgtctcgccagagtcgctgatagtccaccttgggaagggtctcggcagtgatagcgacgaactcgttggccacctcgatgacggcagccatggaattggatcggatcccgggcccgtcgactgcagaggcctgcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 467 - DNA, 43 bp, Artificial Sequence
  Primer YL1051
tgccgacaaaaaggtccagggcgcctagcggccgcaagtgtgg

SEQ ID NO: 468 - DNA, 43 bp, Artificial Sequence
  Primer YL1052
ccacacttgcggccgctaggcgccctggacctttttgtcggca

SEQ ID NO: 469 - DNA, 9119 bp, Artificial Sequence
  Plasmid pZUFmR9G8
cgccggtcccgctcgacctgccggacttcctcccgctacctactacgactctctggccgtcatgggatccgtgaaggcttctcgacaggctctgcccctcgtcatcgacggaaaggtgtacgacgtctccgcttgggtgaacttccaccctggtggagctgaaatcattgagaactaccagggacgagatgctactgacgccttcatggttatgcactctcaggaagccttcgacaagctcaagcgaatgcccaagatcaaccaggcttccgagctgcctccccaggctgccgtcaacgaagctcaggaggatttccgaaagctccgagaagagctgatcgccactggcatgtttgacgcctctcccctctggtactcgtacaagatcttgaccaccctgggtcttggcgtgcttgccttcttcatgctggtccagtaccacctgtacttcattggtgctctcgtgctcggtatgcactaccagcaaatgggatggctgtctcatgacatctgccaccaccagaccttcaagaaccgaaactggaataacgtcctgggtctggtctttggcaacggactccagggcttctccgtgacctggtggaaggacagacacaacgcccatcattctgctaccaacgttcagggtcacgatcccgacattgataacctgcctctgctcgcctggtccgaggacgatgtcactcgagcttctcccatctcccgaaagctcattcagttccaacagtactatttcctggtcatctgtattctcctgcgattcatctggtgtttccagtctgtgctgaccgttcgatccctcaaggaccgagacaaccagttctaccgatctcagtacaagaaagaggccattggactcgctctgcactggactctcaagaccctgttccacctcttctttatgccctccatcctgacctcgatgctggtgttctttgtttccgagctcgtcggtggcttcggaattgccatcgtggtcttcatgaaccactaccctctggagaagatcggtgattccgtctgggacggacatggcttctctgtgggtcagatccatgagaccatgaacattcgacgaggcatcattactgactggttctttggaggcctgaactaccagatcgagcaccatctctggcccaccctgcctcgacacaacctcactgccgtttcctaccaggtggaacagctgtgccagaagcacaacctcccctaccgaaaccctctgccccatgaaggtctcgtcatcctgctccgatacctgtcccagttcgctcgaatggccgagaagcagcccggtgccaaggctcagtaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggctgccgtcatcgaggtggccaacgagttcgtcgctatcactgccgagacccttcccaaggtggactatcagcgactctggcgagacatctactcctgcgagctcctgtacttctccattgctttcgtcatcctcaagtttacccttggcgagctctcggattctggcaaaaagattctgcgagtgctgttcaagtggtacaacctcttcatgtccgtcttttcgctggtgtccttcctctgtatgggttacgccatctacaccgttggactgtactccaacgaatgcgacagagctttcgacaacagcttgttccgatttgccaccaaggtcttctactattccaagtttctggagtacatcgactctttctaccttcccctcatggccaagcctctgtcctttctgcagttctttcatcacttgggagctcctatggacatgtggctcttcgtgcagtactctggcgaatccatttggatctttgtgttcctgaacggattcattcactttgtcatgtacggctactattggacacggctgatgaagttcaactttcccatgcccaagcagctcattaccgcaatgcagatcacccagttcaacgttggcttctacctcgtgtggtggtacaaggacattccctgttaccgaaaggatcccatgcgaatgctggcctggatcttcaactactggtacgtcggtaccgttcttctgctcttcatcaacttctttgtcaagtcctacgtgtttcccaagcctaagactgccgacaaaaaggtccaggg

SEQ ID NO: 470 - DNA, 2127 bp, Artificial Sequence
  Multizyme: E389D9eS/EgD8M gene fusion
  CDS (1)..(2127): Multizyme: E389D9eS/EgD8M gene fusion
atggctgccgtcatcgaggtggccaacgagttcgtcgctatcactgccgagacccttcccaaggtggactatcagcgactctggcgagacatctactcctgcgagctcctgtacttctccattgctttcgtcatcctcaagtttacccttggcgagctctcggattctggcaaaaagattctgcgagtgctgttcaagtggtacaacctcttcatgtccgtcttttcgctggtgtccttcctctgtatgggttacgccatctacaccgttggactgtactccaacgaatgcgacagagctttcgacaacagcttgttccgatttgccaccaaggtcttctactattccaagtttctggagtacatcgactctttctaccttcccctcatggccaagcctctgtcctttctgcagttctttcatcacttgggagctcctatggacatgtggctcttcgtgcagtactctggcgaatccatttggatctttgtgttcctgaacggattcattcactttgtcatgtacggctactattggacacggctgatgaagttcaactttcccatgcccaagcagctcattaccgcaatgcagatcacccagttcaacgttggcttctacctcgtgtggtggtacaaggacattccctgttaccgaaaggatcccatgcgaatgctggcctggatcttcaactactggtacgtcggtaccgttcttctgctcttcatcaacttctttgtcaagtcctacgtgtttcccaagcctaagactgccgacaaaaaggtccagggcgccggtcccgctcgacctgccggacttcctcccgctacctactacgactctctggccgtcatgggatccgtgaaggcttctcgacaggctctgcccctcgtcatcgacggaaaggtgtacgacgtctccgcttgggtgaacttccaccctggtggagctgaaatcattgagaactaccagggacgagatgctactgacgccttcatggttatgcactctcaggaagccttcgacaagctcaagcgaatgcccaagatcaaccaggcttccgagctgcctccccaggctgccgtcaacgaagctcaggaggatttccgaaagctccgagaagagctgatcgccactggcatgtttgacgcctctcccctctggtactcgtacaagatcttgaccaccctgggtcttggcgtgcttgccttcttcatgctggtccagtaccacctgtacttcattggtgctctcgtgctcggtatgcactaccagcaaatgggatggctgtctcatgacatctgccaccaccagaccttcaagaaccgaaactggaataacgtcctgggtctggtctttggcaacggactccagggcttctccgtgacctggtggaaggacagacacaacgcccatcattctgctaccaacgttcagggtcacgatcccgacattgataacctgcctctgctcgcctggtccgaggacgatgtcactcgagcttctcccatctcccgaaagctcattcagttccaacagtactatttcctggtcatctgtattctcctgcgattcatctggtgtttccagtctgtgctgaccgttcgatccctcaaggaccgagacaaccagttctaccgatctcagtacaagaaagaggccattggactcgctctgcactggactctcaagaccctgttccacctcttctttatgccctccatcctgacctcgatgctggtgttctttgtttccgagctcgtcggtggcttcggaattgccatcgtggtcttcatgaaccactaccctctggagaagatcggtgattccgtctgggacggacatggcttctctgtgggtcagatccatgagaccatgaacattcgacgaggcatcattactgactggttctttggaggcctgaactaccagatcgagcaccatctctggcccaccctgcctcgacacaacctcactgccgtttcctaccaggtggaacagctgtgccagaagcacaacctcccctaccgaaaccctctgccccatgaaggtctcgtcatcctgctccgatacctgtcccagttcgctcgaatggccgagaagcagcccggtgccaaggctcagtaa

SEQ ID NO: 471 - protein, 708 aa, Artificial Sequence
  Synthetic Construct
MAAVIEVANEFVAITAETLPKVDYQRLWRDIYSCELLYFSIAFVILKFTLGELSDSGKKILRVLFKWYNLFMSVFSLVSFLCMGYAIYTVGLYSNECDRAFDNSLFRFATKVFYYSKFLEYIDSFYLPLMAKPLSFLQFFHHLGAPMDMWLFVQYSGESIWIFVFLNGFIHFVMYGYYWTRLMKFNFPMPKQLITAMQITQFNVGFYLVWWYKDIPCYRKDPMRMLAWIFNYWYVGTVLLLFINFFVKSYVFPKPKTADKKVQGAGPARPAGLPPATYYDSLAVMGSVKASRQALPLVIDGKVYDVSAWVNFHPGGAEIIENYQGRDATDAFMVMHSQEAFDKLKRMPKINQASELPPQAAVNEAQEDFRKLREELIATGMFDASPLWYSYKILTTLGLGVLAFFMLVQYHLYFIGALVLGMHYQQMGWLSHDICHHQTFKNRNWNNVLGLVFGNGLQGFSVTWWKDRHNAHHSATNVQGHDPDIDNLPLLAWSEDDVTRASPISRKLIQFQQYYFLVICILLRFIWCFQSVLTVRSLKDRDNQFYRSQYKKEAIGLALHWTLKTLFHLFFMPSILTSMLVFFVSELVGGFGIAIVVFMNHYPLEKIGDSVWDGHGFSVGQIHETMNIRRGIITDWFFGGLNYQIEHHLWPTLPRHNLTAVSYQVEQLCQKHNLPYRNPLPHEGLVILLRYLSQFARMAEKQPGAKAQ

SEQ ID NO: 472 - protein, 22 aa, artificial
  EgDHAsyn1 proline-rich linkger plus 4 amino acids
PARPAGLPPATYYDSLAVSGRT

SEQ ID NO: 473 - DNA, 6267 bp, artificial
  Plasmid pKR1007
  misc_feature (4081)..(4081): n is a, c, g, or t
ggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatcctgcaggtctagaggatccccgggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactctagacgtacgtcctcgaagagaagggttaataacacattttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggccgcaccatgtctcctaagcggcaagctctgccaatcacaattgatggcgcaacttatgatgtgtctgcttgggtcaatcaccaccctggaggagctgacattatcgagaactatcgcaaccgcgatgcgaccgatgtcttcatggtgatgcactctcaagaagccgtcgccaagttgaagagaatgcctgttatggagccttcctctcctgacacacctgttgcacccaagcctaagcgtgatgagccccaggaggatttccgcaagttgcgggaggaattcatctccaagggtatgttcgagacgagtttcctttggtatttttacaagacttcaactaccgtcggtttgatggtcctttccatcttgatgaccgtgtacacgaattggtatttcaccgctgctttggttcttggcgtgtgctaccaacagctaggctggttgtcccacgactattgccatcaccaggttttcacaaaccgcaagattaacgacgctttcggtctctttttcggtaacgtgatgcagggatactcacagacttggtggaaggataggcacaatggtcaccatgccgccaccaatgtggtcggccatgacccagatattgataacctccccatcctggcttggtctcccgaagatgtcaagagggctactccttcgactcggaatctcatcaagtaccagcagtactacttcattcccaccattgcatcccttaggttcatctggtgcctccaatccatcggcggcgtcatgtcctacaagagcgaggagaggaacctgtactacaagcgccagtacactaaggaggcgattggtctggccctccactgggtgctcaaggccactttctattgcagtgccatgcctagctttgccaccggtttgggatgcttcttgatctccgagctgctcggaggatttggcattgccatcgttgtgtttctgaatcactatcctttggacaaggttgaggagactgtctgggatgagcacgggttcagcgccagccagatccacgagacgttgaacattaagcccggccttctcaccgattgggtctttggtggtctcaactaccagattgagcaccacttgtggcccaacatgcccaggcacaacctcacggcagcttccctggaggtgcagaagttgtgcgccaagcacaacctgccctacagggccccagccatcatccccggggttcagaaattggtcagcttcttaggcgagattgcccagctggctgctgtccctgaatgagc

SEQ ID NO: 474 - DNA, 11459 bp, artificial
  Plasmid pKR1014
  misc_feature (10262)..(10262): n is a, c, g, or t
ggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatggaggtggtgaatgaaatagtctcaattgggcaggaagttttacccaaagttgattatgcccaactctggagtgatgccagtcactgtgaggtgctttacttgtccatcgcatttgtcatcttgaagttcactcttggcccccttggtccaaaaggtcagtctcgtatgaagtttgttttcaccaattacaaccttctcatgtccatttattcgttgggatcattcctctcaatggcatatgccatgtacaccatcggtgttatgtctgacaactgcgagaaggcttttgacaacaacgtcttcaggatcaccacgcagttgttctatttgagcaagttcctggagtatattgactccttctatttgccactgatgggcaagcctctgacctggttgcaattcttccatcatttgggggcaccgatggatatgtggctgttctataattaccgaaatgaagctgtttggatttttgtgctgttgaatggtttcatccactggatcatgtacggttattattggaccagattgatcaagctgaagttccccatgccaaaatccctgattacatcaatgcagatcattcaattcaatgttggtttctacattgtctggaagtacaggaacattccctgttatcgccaagatgggatgaggatgtttggctggttcttcaattacttttatgttggcacagtcttgtgtttgttcttgaatttctatgtgcaaacgtatatcgtcaggaagcacaagggagccaaaaagattcagtgagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggatataatgagccgtaaacaaagatgattaagtagtaattaatacgtactagtaaaagtggcaaaagataacgagaaagaaccaatttctttgcattcggccttagcggaaggcatatataagctttgattattttatttagtgtaatgatttcgtacaaccaaagcatttatttagtactctcacacttgtgtcgcggccgctcattcagggacagcagccagctgggcaatctcgcctaagaagctgaccaatttctgaaccccggggatgatggctggggccctgtagggcaggttgtgcttggcgcacaacttctgcacctccagggaagctgccgtgaggttgtgcctgggcatgttgggccacaagtggtgctcaatctggtagttgagaccaccaaagacccaatcggtgagaaggccgggcttaatgttcaacgtctcgtggatctggctggcgctgaacccgtgctcatcccagacagtctcctcaaccttgtccaaaggatagtgattcagaaacacaacgatggcaatgccaaatcctccgagcagctcggagatcaagaagcatcccaaaccggtggcaaagctaggcatggcactgcaatagaaagtggccttgagcacccagtggagggccagaccaatcgcctccttagtgtactggcgcttgtagtacaggttcctctcctcgctcttgtaggacatgacgccgccgatggattggaggcaccagatgaacctaagggatgcaatggtgggaatgaagtagtactgctggtacttgatgagattccgagtcgaaggagtagccctcttgacatcttcgggagaccaagccaggatggggaggttatcaatatctgggtcatggccgaccacattggtggcggcatggtgaccattgtgcctatccttccaccaagtctgtgagtatccctgcatcacgttaccgaaaaagagaccgaaagcgtcgttaatcttgcggtttgtgaaaacctggtgatggcaatagtcgtgggacaaccagcctagctgttggtagcacacgccaagaaccaaagcagcggtgaaataccaattcgtgtacacggtcatcaagatggaaaggaccatcaaaccgacggtagttgaagtcttgtaaaaataccaaaggaaactcgtctcgaacatacccttggagatgaattcctcccgcaacttgcggaaatcctcctggggctcatcacgcttaggcttgggtgcaacaggtgtgtcaggagaggaaggctccataacaggcattctcttcaacttggcgacggcttcttgagagtgcatcaccatgaagacatcggtcgcatcgcggttgcgatagttctcgataatgtcagctcctccagggtggtgattgacccaagcagacacatcataagttgcgccatcaattgtgattggcagagcttgccgcttaggagacatggtgcggccgcttggggggctatggaagactttcttagttagttgtgtgaataagcaatgttgggagaatcgggactacttataggataggaataaaacagaaaagtattaagtgctaatgaaatatttagactgataattaaaatcttcacgtatgtccacttgatataaaaacgtcaggaataaaggaagtacagtagaatttaaaggtactctttttatatatacccgtgttctctttttggctagctagttgcataaaaaataatctatatttttatcattattttaaatatcttatgagatggtaaatatttatcataattttttttactattatttattatttgtgtgtgtaatacatatagaagttaattacaaattttatttactttttcattattttgatatgattcaccattaatttagtgttattatttataatagttcattttaatctttttgtatatattatgcgtgcagtacttttttcctacatataactactattacattttatttatataatatttttattaatgaattttcgtgataatatgtaatattgttcattattatttcagattttttaaaaatatttgtgttattatttatgaaatatgtaatttttttagtatttgattttatgatgataaagtgttctaaattcaaaagaagggggaaagcgtaaacattaaaaaacgtcatcaaacaaaaacaaaatcttgttaataaagataaaactgtttgttttgatcactgttatttcgtaatataaaaacattatttatatttatattgttgacaaccaaatttgcctatcaaatctaaccaatataatgcatgcgtggcaggtaatgtactaccatgaacttaagtcatgacataataaaccgtgaatctgaccaatgcatgtacctanctaaattgtatttgtgacacgaagcaaatgattcaattcacaatggagatgggaaacaaataatgaagaacccagaactaagaaagcttttctgaaaaataaaataaaggcaatgtcaaaagtatactgcatcatcagtccagaaagcacatgatatttttttatcagtatcaatgcagctagttttattttacaatatcgatatagctagtttaaatatattgcagctagatttataaatatttgtgttattatttatcatttgtgtaatcctgtttttagtattttagtttatatatgatgataatgtattccaaatttaaaagaagggaaataaatttaaacaagaaaaaaagtcatcaaacaaaaaacaaatgaaagggtggaaagatgttaccatgtaatgtgaatgttacagtatttcttttattatagagttaacaaattaactaatatgattttgttaataatgataaaatattttttttattattatttcataatataaaaatagtttacttaatataaaaaaaattctatcgttcacaacaaagttggccacctaatttaaccatgcatgtacccatggaccatattaggtaaccatcaaacctgatgaagagataaagagatgaagacttaagtcataacacaaaaccataaaaaacaaaaatacaatcaaccgtcaatctgaccaatgcatgaaaaagctgcaatagtgagtggcgacacaaagcacatgattttcttacaacggagataaaaccaaaaaaatatttcatgaacaacctagaacaaataaagcttttatataataaatatataaataaataaaggctatggaataatatacttcaatatatttggattaaataaattgttggcggggttgatatatttatacacacctaaagtcacttcaatctcattttcacttaacttttattttttttttctttttatttatcataaagagaatattgataatatactttttaacatatttttatgacattttttattggtgaaaacttattaaaaatcataaattttgtaagttagatttatttaaagagttcctcttcttattttaaattttttaataaatttttaaataactaaaatttgtgttaaaaatgttaaaaaatgtgttattaacccttctcttcgaggacgtacgtctagagtcgacctgca

SEQ ID NO: 475 - DNA, 34 bp, artificial
  Primer EaD8-5
gcggccgcaccatggtgaaaaggccagcacttcc

SEQ ID NO: 476 - DNA, 30 bp, artificial
  Primer EaD8-3
gcggccgcttacgccttgtcggcctttgcc

SEQ ID NO: 477 - DNA, 4794 bp, artificial
  Plasmid pLF120-3
ttgtaatacgactcactatagggcgaattgggccctctagatgcatgctcgagcggccgccagtgtgatggatatctgcagaattcaggcctgaattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaagcggccgcaccatggtgaaaaggccagcacttccgctgaccgttgatggtgtcacctatgatgtgtctgcctggttgaaccatcatccagggggtgctgacatcattgagaactaccgcggtcgtgatgccactgatgtctttatggttatgcactctgaaaatgctgtgagtaaactaagaaggatgcctatcatggaaccatcatctccactgacgcctacgccaccgaaacccaactcagacgaaccgcaggaggatttccgcaagctccgagatgagctcatcgcagcaggaatgttcgacgcatcaccgatgtggtacgcatataagacgctcagtacgctgggcctcggggtcctcgcggtgctattgatgacccagtggcactggtacctcgtcggggcaatcgtgttgggcattcacttccaacaaatgggttggttgtcgcacgatatctgccaccatcagctgttcaaggaccgatcgatcaacaacgccatcggcttgcttttcgggaacgtcttgcaagggttctctgtgacctggtggaaggacaggcacaatgcacaccactccgccaccaacgtgcaaggccacgaccccgacattgacaacctgccgctgctggcatggtccaaggaggacgtggagagggccggcccgttctcacggcggatgatcaagtaccagcaatactacttcttcttcatctgtgccctcctgaggttcatctggtgcttccagagcatccacacagccacgggcctgaaggatcgcagcaaccagtactaccgcaggcagtacgagaaagagagcgtgggcctggccctccactggggcctgaaggcgttgttctactacttttatatgccaagcttcttgaccggactcatggtgtttttcgtgtccgagttgcttgggggcttcggcatcgccatcgtggtgttcatgaaccactaccccctggagaagatccaggactcggtgtgggacggccacggcttttgcgccggccagattcacgaaacgatgaacgtccagcggggactcgtcacggactggttcttcggtgggctgaattaccaaatcgagcaccacctgtggccgacgctgccccggcacaacctgacggcggccagcatcaaagtggagcagttgtgcaagaagcacaacttgccgtatcgcagccccccaatgctggagggggtgggcatcctgatcagctacctgggcacctttgcccgcatggtggcaaaggccgacaaggcgtaagcggccgc

SEQ ID NO: 478 - DNA, 6526 bp, artificial
  Plasmid pKR1138
  misc_feature (4340)..(4340): n is a, c, g, or t
ggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccggtctagaggatccaaggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgcgtacgtgggcggatcccccgggctgcaggaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactcgacgtacgtcctcgaagagaagggttaataacacattttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggccgcaccatggtgaaaaggccagcacttccgctgaccgttgatggtgtcacctatgatgtgtctgcctggttgaaccatcatccagggggtgctgacatcattgagaactaccgcggtcgtgatgccactgatgtctttatggttatgcactctgaaaatgctgtgagtaaactaagaaggatgcctatcatggaaccatcatctccactgacgcctacgccaccgaaacccaactcagacgaaccgcaggaggatttccgcaagctccgagatgagctcatcgcagcaggaatgttcgacgcatcaccgatgtggtacgcatataagacgctcagtacgctgggcctcggggtcctcgcggtgctattgatgacccagtggcactggtacctcgtcggggcaatcgtgttgggcattcacttccaacaaatgggttggttgtcgcacgatatctgccaccatcagctgttcaaggaccgatcgatcaacaacgccatcggcttgcttttcgggaacgtcttgcaagggttctctgtgacctggtggaaggacaggcacaatgcacaccactccgccaccaacgtgcaaggccacgaccccgacattgacaacctgccgctgctggcatggtccaaggaggacgtggagagggccggcccgttctcacggcggatgatcaagtaccagcaatactacttcttcttcatctgtgccctcctgaggttcatctggtgcttccagagcatccacacagccacgggcctgaaggatcgcagcaaccagtactaccgcaggcagtacgagaaagagagcgtgggcctggccctccactggggcctgaaggcgttgttctactacttttatatgccaagcttcttgaccggactcatggtgtttttcgtgtccgagttgcttgggggcttcggcatcgccatcgtggtgttcatgaaccactaccccctggagaagatccaggactcggtgtgggacggccacggcttttgcgccggccagattcacgaaacgatgaacgtccagcggggactcgtcacggactggttcttcggtgggctgaattaccaaatcgagcaccacctgtggccgacgctgccccggcacaacctgacggcggccagcatcaaagtggagcagttgtgcaagaagcacaacttgccgtatcgcagccccccaatgctggagggggtgggcatcctgatcagctacctgggcacctttgcccgcatggtggcaaaggccgacaaggcgtaagc

SEQ ID NO: 479 - DNA, 11707 bp, artificial
  Plasmid pKR1152
  misc_feature (10532)..(10532): n is a, c, g, or t
gtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatggaggtggtgaatgaaatagtctcaattgggcaggaagttttacccaaagttgattatgcccaactctggagtgatgccagtcactgtgaggtgctttacttgtccatcgcatttgtcatcttgaagttcactcttggcccccttggtccaaaaggtcagtctcgtatgaagtttgttttcaccaattacaaccttctcatgtccatttattcgttgggatcattcctctcaatggcatatgccatgtacaccatcggtgttatgtctgacaactgcgagaaggcttttgacaacaacgtcttcaggatcaccacgcagttgttctatttgagcaagttcctggagtatattgactccttctatttgccactgatgggcaagcctctgacctggttgcaattcttccatcatttgggggcaccgatggatatgtggctgttctataattaccgaaatgaagctgtttggatttttgtgctgttgaatggtttcatccactggatcatgtacggttattattggaccagattgatcaagctgaagttccccatgccaaaatccctgattacatcaatgcagatcattcaattcaatgttggtttctacattgtctggaagtacaggaacattccctgttatcgccaagatgggatgaggatgtttggctggttcttcaattacttttatgttggcacagtcttgtgtttgttcttgaatttctatgtgcaaacgtatatcgtcaggaagcacaagggagccaaaaagattcagtgagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgcaaaggcaaagatttaaactcgaaaacattacaaaagtctcaaaacagaggcaaggccatgcacaaagcacactctaagtgcttccattgcctactaagtagggtacgtacacgatcaccattcaccagtgatgatctttattaatatacaacacactcagagacagcttatgttatagctagctagcataaactatcacatcatgtgttagtacgacaagtgacaacattgcttttaacttcgcggccttggatcctctagaccggatataatgagccgtaaacaaagatgattaagtagtaattaatacgtactagtaaaagtggcaaaagataacgagaaagaaccaatttctttgcattcggccttagcggaaggcatatataagctttgattattttatttagtgtaatgatttcgtacaaccaaagcatttatttagtactctcacacttgtgtcgcggccgcttacgccttgtcggcctttgccaccatgcgggcaaaggtgcccaggtagctgatcaggatgcccaccccctccagcattggggggctgcgatacggcaagttgtgcttcttgcacaactgctccactttgatgctggccgccgtcaggttgtgccggggcagcgtcggccacaggtggtgctcgatttggtaattcagcccaccgaagaaccagtccgtgacgagtccccgctggacgttcatcgtttcgtgaatctggccggcgcaaaagccgtggccgtcccacaccgagtcctggatcttctccagggggtagtggttcatgaacaccacgatggcgatgccgaagcccccaagcaactcggacacgaaaaacaccatgagtccggtcaagaagcttggcatataaaagtagtagaacaacgccttcaggccccagtggagggccaggcccacgctctctttctcgtactgcctgcggtagtactggttgctgcgatccttcaggcccgtggctgtgtggatgctctggaagcaccagatgaacctcaggagggcacagatgaagaagaagtagtattgctggtacttgatcatccgccgtgagaacgggccggccctctccacgtcctccttggaccatgccagcagcggcaggttgtcaatgtcggggtcgtggccttgcacgttggtggcggagtggtgtgcattgtgcctgtccttccaccaggtcacagagaacccttgcaagacgttcccgaaaagcaagccgatggcgttgttgatcgatcggtccttgaacagctgatggtggcagatatcgtgcgacaaccaacccatttgttggaagtgaatgcccaacacgattgccccgacgaggtaccagtgccactgggtcatcaatagcaccgcgaggaccccgaggcccagcgtactgagcgtcttatatgcgtaccacatcggtgatgcgtcgaacattcctgctgcgatgagctcatctcggagcttgcggaaatcctcctgcggttcgtctgagttgggtttcggtggcgtaggcgtcagtggagatgatggttccatgataggcatccttcttagtttactcacagcattttcagagtgcataaccataaagacatcagtggcatcacgaccgcggtagttctcaatgatgtcagcaccccctggatgatggttcaaccaggcagacacatcataggtgacaccatcaacggtcagcggaagtgctggccttttcaccatggtgcggccgcttggggggctatggaagactttcttagttagttgtgtgaataagcaatgttgggagaatcgggactacttataggataggaataaaacagaaaagtattaagtgctaatgaaatatttagactgataattaaaatcttcacgtatgtccacttgatataaaaacgtcaggaataaaggaagtacagtagaatttaaaggtactctttttatatatacccgtgttctctttttggctagctagttgcataaaaaataatctatatttttatcattattttaaatatcttatgagatggtaaatatttatcataattttttttactattatttattatttgtgtgtgtaatacatatagaagttaattacaaattttatttactttttcattattttgatatgattcaccattaatttagtgttattatttataatagttcattttaatctttttgtatatattatgcgtgcagtacttttttcctacatataactactattacattttatttatataatatttttattaatgaattttcgtgataatatgtaatattgttcattattatttcagattttttaaaaatatttgtgttattatttatgaaatatgtaatttttttagtatttgattttatgatgataaagtgttctaaattcaaaagaagggggaaagcgtaaacattaaaaaacgtcatcaaacaaaaacaaaatcttgttaataaagataaaactgtttgttttgatcactgttatttcgtaatataaaaacattatttatatttatattgttgacaaccaaatttgcctatcaaatctaaccaatataatgcatgcgtggcaggtaatgtactaccatgaacttaagtcatgacataataaaccgtgaatctgaccaatgcatgtacctanctaaattgtatttgtgacacgaagcaaatgattcaattcacaatggagatgggaaacaaataatgaagaacccagaactaagaaagcttttctgaaaaataaaataaaggcaatgtcaaaagtatactgcatcatcagtccagaaagcacatgatatttttttatcagtatcaatgcagctagttttattttacaatatcgatatagctagtttaaatatattgcagctagatttataaatatttgtgttattatttatcatttgtgtaatcctgtttttagtattttagtttatatatgatgataatgtattccaaatttaaaagaagggaaataaatttaaacaagaaaaaaagtcatcaaacaaaaaacaaatgaaagggtggaaagatgttaccatgtaatgtgaatgttacagtatttcttttattatagagttaacaaattaactaatatgattttgttaataatgataaaatattttttttattattatttcataatataaaaatagtttacttaatataaaaaaaattctatcgttcacaacaaagttggccacctaatttaaccatgcatgtacccatggaccatattaggtaaccatcaaacctgatgaagagataaagagatgaagacttaagtcataacacaaaaccataaaaaacaaaaatacaatcaaccgtcaatctgaccaatgcatgaaaaagctgcaatagtgagtggcgacacaaagcacatgattttcttacaacggagataaaaccaaaaaaatatttcatgaacaacctagaacaaataaagcttttatataataaatatataaataaataaaggctatggaataatatacttcaatatatttggattaaataaattgttggcggggttgatatatttatacacacctaaagtcacttcaatctcattttcacttaacttttattttttttttctttttatttatcataaagagaatattgataatatactttttaacatatttttatgacattttttattggtgaaaacttattaaaaatcataaattttgtaagttagatttatttaaagagttcctcttcttattttaaattttttaataaatttttaaataactaaaatttgtgttaaaaatgttaaaaaatgtgttattaacccttctcttcgaggac

SEQ ID NO: 480 - DNA, 26 bp, artificial
  Primer oEAd9el1-2
tgcggccgctactccttcttccctcg

SEQ ID NO: 481 - DNA, 4310 bp, artificial
  Plasmid pKR1137
aattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaagcccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgtatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgccagtgtgatggatatctgcagaattcaggagcggccgcaccatggaagcagccaaagaattggtttccatcgtccaagaggagctccccaaggtggactatgcccagctttggcaggatgccagcagctgtgaggtcctttacctctcggtggcattcgtggcgatcaagttcatgctgcgcccactggacctgaagcgccaggccaccttgaagaagctgttcacagcatacaacttcctcatgtcgatctattcctttggctccttcctggccatggcctatgccctatcagtaactggcatcctctccggcgactgtgagacggcgttcaacaacgatgtgttcaggatcacaactcagctgttctacctcagcaagttcgtagagtacatcgactccttctaccttccccttatggacaagccactgtcgttccttcagttcttccatcatttgggggcccccattgacatgtggctattctacaaataccgcaacgaaggagtctggatctttgtcctgttgaatgggttcattcactggatcatgtacggttactattggacgcggctcatcaagctgaacttccccatgcccaagaacctgatcacctccatgcagatcatccagttcaatgtcgggttctacatcgtctggaagtaccgcaatgtgccatgctaccgccaggatgggatgcgcatgtttgcctggatcttcaactactggtatgtcgggacggtcttgctgctgttcctcaacttttacgtgcagacgtacatccggaagccgaggaagaaccgagggaagaaggagtagcggccgcacctg

SEQ ID NO: 482 - DNA, 7872 bp, artificial
  Plasmid pKR1140
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatggaagcagccaaagaattggtttccatcgtccaagaggagctccccaaggtggactatgcccagctttggcaggatgccagcagctgtgaggtcctttacctctcggtggcattcgtggcgatcaagttcatgctgcgcccactggacctgaagcgccaggccaccttgaagaagctgttcacagcatacaacttcctcatgtcgatctattcctttggctccttcctggccatggcctatgccctatcagtaactggcatcctctccggcgactgtgagacggcgttcaacaacgatgtgttcaggatcacaactcagctgttctacctcagcaagttcgtagagtacatcgactccttctaccttccccttatggacaagccactgtcgttccttcagttcttccatcatttgggggcccccattgacatgtggctattctacaaataccgcaacgaaggagtctggatctttgtcctgttgaatgggttcattcactggatcatgtacggttactattggacgcggctcatcaagctgaacttccccatgcccaagaacctgatcacctccatgcagatcatccagttcaatgtcgggttctacatcgtctggaagtaccgcaatgtgccatgctaccgccaggatgggatgcgcatgtttgcctggatcttcaactactggtatgtcgggacggtcttgctgctgttcctcaacttttacgtgcagacgtacatccggaagccgaggaagaaccgagggaagaaggagtagc

SEQ ID NO: 483 - DNA, 6526 bp, artificial
  Plasmid pKR1145
  misc_feature (4340)..(4340): n is a, c, g, or t
ggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccggtctagaggatccaaggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgcgtacgtgggcggatcccccgggctgcaggaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactcgacgtacgtcctcgaagagaagggttaataacacattttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggccgcaccatgtctcctaagcggcaagctctgccaatcacaattgatggcgcaacttatgatgtgtctgcttgggtcaatcaccaccctggaggagctgacattatcgagaactatcgcaaccgcgatgcgaccgatgtcttcatggtgatgcactctcaagaagccgtcgccaagttgaagagaatgcctgttatggagccttcctctcctgacacacctgttgcacccaagcctaagcgtgatgagccccaggaggatttccgcaagttgcgggaggaattcatctccaagggtatgttcgagacgagtttcctttggtatttttacaagacttcaactaccgtcggtttgatggtcctttccatcttgatgaccgtgtacacgaattggtatttcaccgctgctttggttcttggcgtgtgctaccaacagctaggctggttgtcccacgactattgccatcaccaggttttcacaaaccgcaagattaacgacgctttcggtctctttttcggtaacgtgatgcagggatactcacagacttggtggaaggataggcacaatggtcaccatgccgccaccaatgtggtcggccatgacccagatattgataacctccccatcctggcttggtctcccgaagatgtcaagagggctactccttcgactcggaatctcatcaagtaccagcagtactacttcattcccaccattgcatcccttaggttcatctggtgcctccaatccatcggcggcgtcatgtcctacaagagcgaggagaggaacctgtactacaagcgccagtacactaaggaggcgattggtctggccctccactgggtgctcaaggccactttctattgcagtgccatgcctagctttgccaccggtttgggatgcttcttgatctccgagctgctcggaggatttggcattgccatcgttgtgtttctgaatcactatcctttggacaaggttgaggagactgtctgggatgagcacgggttcagcgccagccagatccacgagacgttgaacattaagcccggccttctcaccgattgggtctttggtggtctcaactaccagattgagcaccacttgtggcccaacatgcccaggcacaacctcacggcagcttccctggaggtgcagaagttgtgcgccaagcacaacctgccctacagggccccagccatcatccccggggttcagaaattggtcagcttcttaggcgagattgcccagctggctgctgtccctgaatgagc

SEQ ID NO: 484 - DNA, 11706 bp, artificial
  Plasmid pKR1151
  misc_feature (10531)..(10531): n is a, c, g, or t
gtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatggaagcagccaaagaattggtttccatcgtccaagaggagctccccaaggtggactatgcccagctttggcaggatgccagcagctgtgaggtcctttacctctcggtggcattcgtggcgatcaagttcatgctgcgcccactggacctgaagcgccaggccaccttgaagaagctgttcacagcatacaacttcctcatgtcgatctattcctttggctccttcctggccatggcctatgccctatcagtaactggcatcctctccggcgactgtgagacggcgttcaacaacgatgtgttcaggatcacaactcagctgttctacctcagcaagttcgtagagtacatcgactccttctaccttccccttatggacaagccactgtcgttccttcagttcttccatcatttgggggcccccattgacatgtggctattctacaaataccgcaacgaaggagtctggatctttgtcctgttgaatgggttcattcactggatcatgtacggttactattggacgcggctcatcaagctgaacttccccatgcccaagaacctgatcacctccatgcagatcatccagttcaatgtcgggttctacatcgtctggaagtaccgcaatgtgccatgctaccgccaggatgggatgcgcatgtttgcctggatcttcaactactggtatgtcgggacggtcttgctgctgttcctcaacttttacgtgcagacgtacatccggaagccgaggaagaaccgagggaagaaggagtagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgcaaaggcaaagatttaaactcgaaaacattacaaaagtctcaaaacagaggcaaggccatgcacaaagcacactctaagtgcttccattgcctactaagtagggtacgtacacgatcaccattcaccagtgatgatctttattaatatacaacacactcagagacagcttatgttatagctagctagcataaactatcacatcatgtgttagtacgacaagtgacaacattgcttttaacttcgcggccttggatcctctagaccggatataatgagccgtaaacaaagatgattaagtagtaattaatacgtactagtaaaagtggcaaaagataacgagaaagaaccaatttctttgcattcggccttagcggaaggcatatataagctttgattattttatttagtgtaatgatttcgtacaaccaaagcatttatttagtactctcacacttgtgtcgcggccgctcattcagggacagcagccagctgggcaatctcgcctaagaagctgaccaatttctgaaccccggggatgatggctggggccctgtagggcaggttgtgcttggcgcacaacttctgcacctccagggaagctgccgtgaggttgtgcctgggcatgttgggccacaagtggtgctcaatctggtagttgagaccaccaaagacccaatcggtgagaaggccgggcttaatgttcaacgtctcgtggatctggctggcgctgaacccgtgctcatcccagacagtctcctcaaccttgtccaaaggatagtgattcagaaacacaacgatggcaatgccaaatcctccgagcagctcggagatcaagaagcatcccaaaccggtggcaaagctaggcatggcactgcaatagaaagtggccttgagcacccagtggagggccagaccaatcgcctccttagtgtactggcgcttgtagtacaggttcctctcctcgctcttgtaggacatgacgccgccgatggattggaggcaccagatgaacctaagggatgcaatggtgggaatgaagtagtactgctggtacttgatgagattccgagtcgaaggagtagccctcttgacatcttcgggagaccaagccaggatggggaggttatcaatatctgggtcatggccgaccacattggtggcggcatggtgaccattgtgcctatccttccaccaagtctgtgagtatccctgcatcacgttaccgaaaaagagaccgaaagcgtcgttaatcttgcggtttgtgaaaacctggtgatggcaatagtcgtgggacaaccagcctagctgttggtagcacacgccaagaaccaaagcagcggtgaaataccaattcgtgtacacggtcatcaagatggaaaggaccatcaaaccgacggtagttgaagtcttgtaaaaataccaaaggaaactcgtctcgaacatacccttggagatgaattcctcccgcaacttgcggaaatcctcctggggctcatcacgcttaggcttgggtgcaacaggtgtgtcaggagaggaaggctccataacaggcattctcttcaacttggcgacggcttcttgagagtgcatcaccatgaagacatcggtcgcatcgcggttgcgatagttctcgataatgtcagctcctccagggtggtgattgacccaagcagacacatcataagttgcgccatcaattgtgattggcagagcttgccgcttaggagacatggtgcggccgcttggggggctatggaagactttcttagttagttgtgtgaataagcaatgttgggagaatcgggactacttataggataggaataaaacagaaaagtattaagtgctaatgaaatatttagactgataattaaaatcttcacgtatgtccacttgatataaaaacgtcaggaataaaggaagtacagtagaatttaaaggtactctttttatatatacccgtgttctctttttggctagctagttgcataaaaaataatctatatttttatcattattttaaatatcttatgagatggtaaatatttatcataattttttttactattatttattatttgtgtgtgtaatacatatagaagttaattacaaattttatttactttttcattattttgatatgattcaccattaatttagtgttattatttataatagttcattttaatctttttgtatatattatgcgtgcagtacttttttcctacatataactactattacattttatttatataatatttttattaatgaattttcgtgataatatgtaatattgttcattattatttcagattttttaaaaatatttgtgttattatttatgaaatatgtaatttttttagtatttgattttatgatgataaagtgttctaaattcaaaagaagggggaaagcgtaaacattaaaaaacgtcatcaaacaaaaacaaaatcttgttaataaagataaaactgtttgttttgatcactgttatttcgtaatataaaaacattatttatatttatattgttgacaaccaaatttgcctatcaaatctaaccaatataatgcatgcgtggcaggtaatgtactaccatgaacttaagtcatgacataataaaccgtgaatctgaccaatgcatgtacctanctaaattgtatttgtgacacgaagcaaatgattcaattcacaatggagatgggaaacaaataatgaagaacccagaactaagaaagcttttctgaaaaataaaataaaggcaatgtcaaaagtatactgcatcatcagtccagaaagcacatgatatttttttatcagtatcaatgcagctagttttattttacaatatcgatatagctagtttaaatatattgcagctagatttataaatatttgtgttattatttatcatttgtgtaatcctgtttttagtattttagtttatatatgatgataatgtattccaaatttaaaagaagggaaataaatttaaacaagaaaaaaagtcatcaaacaaaaaacaaatgaaagggtggaaagatgttaccatgtaatgtgaatgttacagtatttcttttattatagagttaacaaattaactaatatgattttgttaataatgataaaatattttttttattattatttcataatataaaaatagtttacttaatataaaaaaaattctatcgttcacaacaaagttggccacctaatttaaccatgcatgtacccatggaccatattaggtaaccatcaaacctgatgaagagataaagagatgaagacttaagtcataacacaaaaccataaaaaacaaaaatacaatcaaccgtcaatctgaccaatgcatgaaaaagctgcaatagtgagtggcgacacaaagcacatgattttcttacaacggagataaaaccaaaaaaatatttcatgaacaacctagaacaaataaagcttttatataataaatatataaataaataaaggctatggaataatatacttcaatatatttggattaaataaattgttggcggggttgatatatttatacacacctaaagtcacttcaatctcattttcacttaacttttattttttttttctttttatttatcataaagagaatattgataatatactttttaacatatttttatgacattttttattggtgaaaacttattaaaaatcataaattttgtaagttagatttatttaaagagttcctcttcttattttaaattttttaataaatttttaaataactaaaatttgtgttaaaaatgttaaaaaatgtgttattaacccttctcttcgaggac

SEQ ID NO: 485 - DNA, 11706 bp, artificial
  Plasmid pKR1150
  misc_feature (10531)..(10531): n is a, c, g, or t
gtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatggaagcagccaaagaattggtttccatcgtccaagaggagctccccaaggtggactatgcccagctttggcaggatgccagcagctgtgaggtcctttacctctcggtggcattcgtggcgatcaagttcatgctgcgcccactggacctgaagcgccaggccaccttgaagaagctgttcacagcatacaacttcctcatgtcgatctattcctttggctccttcctggccatggcctatgccctatcagtaactggcatcctctccggcgactgtgagacggcgttcaacaacgatgtgttcaggatcacaactcagctgttctacctcagcaagttcgtagagtacatcgactccttctaccttccccttatggacaagccactgtcgttccttcagttcttccatcatttgggggcccccattgacatgtggctattctacaaataccgcaacgaaggagtctggatctttgtcctgttgaatgggttcattcactggatcatgtacggttactattggacgcggctcatcaagctgaacttccccatgcccaagaacctgatcacctccatgcagatcatccagttcaatgtcgggttctacatcgtctggaagtaccgcaatgtgccatgctaccgccaggatgggatgcgcatgtttgcctggatcttcaactactggtatgtcgggacggtcttgctgctgttcctcaacttttacgtgcagacgtacatccggaagccgaggaagaaccgagggaagaaggagtagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgcaaaggcaaagatttaaactcgaaaacattacaaaagtctcaaaacagaggcaaggccatgcacaaagcacactctaagtgcttccattgcctactaagtagggtacgtacacgatcaccattcaccagtgatgatctttattaatatacaacacactcagagacagcttatgttatagctagctagcataaactatcacatcatgtgttagtacgacaagtgacaacattgcttttaacttcgcggccttggatcctctagaccggatataatgagccgtaaacaaagatgattaagtagtaattaatacgtactagtaaaagtggcaaaagataacgagaaagaaccaatttctttgcattcggccttagcggaaggcatatataagctttgattattttatttagtgtaatgatttcgtacaaccaaagcatttatttagtactctcacacttgtgtcgcggccgcttacgccttgtcggcctttgccaccatgcgggcaaaggtgcccaggtagctgatcaggatgcccaccccctccagcattggggggctgcgatacggcaagttgtgcttcttgcacaactgctccactttgatgctggccgccgtcaggttgtgccggggcagcgtcggccacaggtggtgctcgatttggtaattcagcccaccgaagaaccagtccgtgacgagtccccgctggacgttcatcgtttcgtgaatctggccggcgcaaaagccgtggccgtcccacaccgagtcctggatcttctccagggggtagtggttcatgaacaccacgatggcgatgccgaagcccccaagcaactcggacacgaaaaacaccatgagtccggtcaagaagcttggcatataaaagtagtagaacaacgccttcaggccccagtggagggccaggcccacgctctctttctcgtactgcctgcggtagtactggttgctgcgatccttcaggcccgtggctgtgtggatgctctggaagcaccagatgaacctcaggagggcacagatgaagaagaagtagtattgctggtacttgatcatccgccgtgagaacgggccggccctctccacgtcctccttggaccatgccagcagcggcaggttgtcaatgtcggggtcgtggccttgcacgttggtggcggagtggtgtgcattgtgcctgtccttccaccaggtcacagagaacccttgcaagacgttcccgaaaagcaagccgatggcgttgttgatcgatcggtccttgaacagctgatggtggcagatatcgtgcgacaaccaacccatttgttggaagtgaatgcccaacacgattgccccgacgaggtaccagtgccactgggtcatcaatagcaccgcgaggaccccgaggcccagcgtactgagcgtcttatatgcgtaccacatcggtgatgcgtcgaacattcctgctgcgatgagctcatctcggagcttgcggaaatcctcctgcggttcgtctgagttgggtttcggtggcgtaggcgtcagtggagatgatggttccatgataggcatccttcttagtttactcacagcattttcagagtgcataaccataaagacatcagtggcatcacgaccgcggtagttctcaatgatgtcagcaccccctggatgatggttcaaccaggcagacacatcataggtgacaccatcaacggtcagcggaagtgctggccttttcaccatggtgcggccgcttggggggctatggaagactttcttagttagttgtgtgaataagcaatgttgggagaatcgggactacttataggataggaataaaacagaaaagtattaagtgctaatgaaatatttagactgataattaaaatcttcacgtatgtccacttgatataaaaacgtcaggaataaaggaagtacagtagaatttaaaggtactctttttatatatacccgtgttctctttttggctagctagttgcataaaaaataatctatatttttatcattattttaaatatcttatgagatggtaaatatttatcataattttttttactattatttattatttgtgtgtgtaatacatatagaagttaattacaaattttatttactttttcattattttgatatgattcaccattaatttagtgttattatttataatagttcattttaatctttttgtatatattatgcgtgcagtacttttttcctacatataactactattacattttatttatataatatttttattaatgaattttcgtgataatatgtaatattgttcattattatttcagattttttaaaaatatttgtgttattatttatgaaatatgtaatttttttagtatttgattttatgatgataaagtgttctaaattcaaaagaagggggaaagcgtaaacattaaaaaacgtcatcaaacaaaaacaaaatcttgttaataaagataaaactgtttgttttgatcactgttatttcgtaatataaaaacattatttatatttatattgttgacaaccaaatttgcctatcaaatctaaccaatataatgcatgcgtggcaggtaatgtactaccatgaacttaagtcatgacataataaaccgtgaatctgaccaatgcatgtacctanctaaattgtatttgtgacacgaagcaaatgattcaattcacaatggagatgggaaacaaataatgaagaacccagaactaagaaagcttttctgaaaaataaaataaaggcaatgtcaaaagtatactgcatcatcagtccagaaagcacatgatatttttttatcagtatcaatgcagctagttttattttacaatatcgatatagctagtttaaatatattgcagctagatttataaatatttgtgttattatttatcatttgtgtaatcctgtttttagtattttagtttatatatgatgataatgtattccaaatttaaaagaagggaaataaatttaaacaagaaaaaaagtcatcaaacaaaaaacaaatgaaagggtggaaagatgttaccatgtaatgtgaatgttacagtatttcttttattatagagttaacaaattaactaatatgattttgttaataatgataaaatattttttttattattatttcataatataaaaatagtttacttaatataaaaaaaattctatcgttcacaacaaagttggccacctaatttaaccatgcatgtacccatggaccatattaggtaaccatcaaacctgatgaagagataaagagatgaagacttaagtcataacacaaaaccataaaaaacaaaaatacaatcaaccgtcaatctgaccaatgcatgaaaaagctgcaatagtgagtggcgacacaaagcacatgattttcttacaacggagataaaaccaaaaaaatatttcatgaacaacctagaacaaataaagcttttatataataaatatataaataaataaaggctatggaataatatacttcaatatatttggattaaataaattgttggcggggttgatatatttatacacacctaaagtcacttcaatctcattttcacttaacttttattttttttttctttttatttatcataaagagaatattgataatatactttttaacatatttttatgacattttttattggtgaaaacttattaaaaatcataaattttgtaagttagatttatttaaagagttcctcttcttattttaaattttttaataaatttttaaataactaaaatttgtgttaaaaatgttaaaaaatgtgttattaacccttctcttcgaggac

SEQ ID NO: 486 - DNA, 5559 bp, artificial; identical to SEQ ID NO: 178
  Plasmid pKR1190

SEQ ID NO: 487 - DNA, 6833 bp, artificial
  Plasmid pKR1195
ggccgcaagtatgaactaaaatgcacgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaaggaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtaaagcaatggttgaccgtgtgcttagcttcttttattttatttttttatcagcaaagaataaataaaataaaatgagacacttcagggatgtttcaacggatcccccgggctgcaggaattcgatatcaagcttatcgataccgtcgacctcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccctagaactagtggatccttcatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactccatggaggtggtgaatgaaatagtctcaattgggcaggaagttttacccaaagttgattatgcccaactctggagtgatgccagtcactgtgaggtgctttacttgtccatcgcatttgtcatcttgaagttcactcttggcccccttggtccaaaaggtcagtctcgtatgaagtttgttttcaccaattacaaccttctcatgtccatttattcgttgggatcattcctctcaatggcatatgccatgtacaccatcggtgttatgtctgacaactgcgagaaggcttttgacaacaacgtcttcaggatcaccacgcagttgttctatttgagcaagttcctggagtatattgactccttctatttgccactgatgggcaagcctctgacctggttgcaattcttccatcatttgggggcaccgatggatatgtggctgttctataattaccgaaatgaagctgtttggatttttgtgctgttgaatggtttcatccactggatcatgtacggttattattggaccagattgatcaagctgaagttccccatgccaaaatccctgattacatcaatgcagatcattcaattcaatgttggtttctacattgtctggaagtacaggaacattccctgttatcgccaagatgggatgaggatgtttggctggttcttcaattacttttatgttggcacagtcttgtgtttgttcttgaatttctatgtgcaaacgtatatcgtcaggaagcacaagggagccaaaaagattcagcccgcccgtccagctggactcccgccggccacgtactacgactccctggcagtgagcggccgcaccatgtctcctaagcggcaagctctgccaatcacaattgatggcgcaacttatgatgtgtctgcttgggtcaatcaccaccctggaggagctgacattatcgagaactatcgcaaccgcgatgcgaccgatgtcttcatggtgatgcactctcaagaagccgtcgccaagttgaagagaatgcctgttatggagccttcctctcctgacacacctgttgcacccaagcctaagcgtgatgagccccaggaggatttccgcaagttgcgggaggaattcatctccaagggtatgttcgagacgagtttcctttggtatttttacaagacttcaactaccgtcggtttgatggtcctttccatcttgatgaccgtgtacacgaattggtatttcaccgctgctttggttcttggcgtgtgctaccaacagctaggctggttgtcccacgactattgccatcaccaggttttcacaaaccgcaagattaacgacgctttcggtctctttttcggtaacgtgatgcagggatactcacagacttggtggaaggataggcacaatggtcaccatgccgccaccaatgtggtcggccatgacccagatattgataacctccccatcctggcttggtctcccgaagatgtcaagagggctactccttcgactcggaatctcatcaagtaccagcagtactacttcattcccaccattgcatcccttaggttcatctggtgcctccaatccatcggcggcgtcatgtcctacaagagcgaggagaggaacctgtactacaagcgccagtacactaaggaggcgattggtctggccctccactgggtgctcaaggccactttctattgcagtgccatgcctagctttgccaccggtttgggatgcttcttgatctccgagctgctcggaggatttggcattgccatcgttgtgtttctgaatcactatcctttggacaaggttgaggagactgtctgggatgagcacgggttcagcgccagccagatccacgagacgttgaacattaagcccggccttctcaccgattgggtctttggtggtctcaactaccagattgagcaccacttgtggcccaacatgcccaggcacaacctcacggcagcttccctggaggtgcagaagttgtgcgccaagcacaacctgccctacagggccccagccatcatccccggggttcagaaattggtcagcttcttaggcgagattgcccagctggctgctgtccctgaatgagc

SEQ ID NO: 488 - DNA, 9190 bp, artificial
  Plasmid pKR1199
gatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatcgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttggatctcctgcaggatctggccggccggatctcgtacggatccttcatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactccatggaggtggtgaatgaaatagtctcaattgggcaggaagttttacccaaagttgattatgcccaactctggagtgatgccagtcactgtgaggtgctttacttgtccatcgcatttgtcatcttgaagttcactcttggcccccttggtccaaaaggtcagtctcgtatgaagtttgttttcaccaattacaaccttctcatgtccatttattcgttgggatcattcctctcaatggcatatgccatgtacaccatcggtgttatgtctgacaactgcgagaaggcttttgacaacaacgtcttcaggatcaccacgcagttgttctatttgagcaagttcctggagtatattgactccttctatttgccactgatgggcaagcctctgacctggttgcaattcttccatcatttgggggcaccgatggatatgtggctgttctataattaccgaaatgaagctgtttggatttttgtgctgttgaatggtttcatccactggatcatgtacggttattattggaccagattgatcaagctgaagttccccatgccaaaatccctgattacatcaatgcagatcattcaattcaatgttggtttctacattgtctggaagtacaggaacattccctgttatcgccaagatgggatgaggatgtttggctggttcttcaattacttttatgttggcacagtcttgtgtttgttcttgaatttctatgtgcaaacgtatatcgtcaggaagcacaagggagccaaaaagattcagcccgcccgtccagctggactcccgccggccacgtactacgactccctggcagtgagcggccgcaccatgtctcctaagcggcaagctctgccaatcacaattgatggcgcaacttatgatgtgtctgcttgggtcaatcaccaccctggaggagctgacattatcgagaactatcgcaaccgcgatgcgaccgatgtcttcatggtgatgcactctcaagaagccgtcgccaagttgaagagaatgcctgttatggagccttcctctcctgacacacctgttgcacccaagcctaagcgtgatgagccccaggaggatttccgcaagttgcgggaggaattcatctccaagggtatgttcgagacgagtttcctttggtatttttacaagacttcaactaccgtcggtttgatggtcctttccatcttgatgaccgtgtacacgaattggtatttcaccgctgctttggttcttggcgtgtgctaccaacagctaggctggttgtcccacgactattgccatcaccaggttttcacaaaccgcaagattaacgacgctttcggtctctttttcggtaacgtgatgcagggatactcacagacttggtggaaggataggcacaatggtcaccatgccgccaccaatgtggtcggccatgacccagatattgataacctccccatcctggcttggtctcccgaagatgtcaagagggctactccttcgactcggaatctcatcaagtaccagcagtactacttcattcccaccattgcatcccttaggttcatctggtgcctccaatccatcggcggcgtcatgtcctacaagagcgaggagaggaacctgtactacaagcgccagtacactaaggaggcgattggtctggccctccactgggtgctcaaggccactttctattgcagtgccatgcctagctttgccaccggtttgggatgcttcttgatctccgagctgctcggaggatttggcattgccatcgttgtgtttctgaatcactatcctttggacaaggttgaggagactgtctgggatgagcacgggttcagcgccagccagatccacgagacgttgaacattaagcccggccttctcaccgattgggtctttggtggtctcaactaccagattgagcaccacttgtggcccaacatgcccaggcacaacctcacggcagcttccctggaggtgcagaagttgtgcgccaagcacaacctgccctacagggccccagccatcatccccggggttcagaaattggtcagcttcttaggcgagattgcccagctggctgctgtccctgaatgagcggccgcaagtatgaactaaaatgcacgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaaggaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtaaagcaatggttgaccgtgtgcttagcttcttttattttatttttttatcagcaaagaataaataaaataaaatgagacacttcagggatgtttcaacg

SEQ ID NO: 489 - DNA, 6833 bp, artificial
  Plasmid pKR1196
ggccgcaagtatgaactaaaatgcacgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaaggaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtaaagcaatggttgaccgtgtgcttagcttcttttattttatttttttatcagcaaagaataaataaaataaaatgagacacttcagggatgtttcaacggatcccccgggctgcaggaattcgatatcaagcttatcgataccgtcgacctcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccctagaactagtggatccttcatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactccatggaggtggtgaatgaaatagtctcaattgggcaggaagttttacccaaagttgattatgcccaactctggagtgatgccagtcactgtgaggtgctttacttgtccatcgcatttgtcatcttgaagttcactcttggcccccttggtccaaaaggtcagtctcgtatgaagtttgttttcaccaattacaaccttctcatgtccatttattcgttgggatcattcctctcaatggcatatgccatgtacaccatcggtgttatgtctgacaactgcgagaaggcttttgacaacaacgtcttcaggatcaccacgcagttgttctatttgagcaagttcctggagtatattgactccttctatttgccactgatgggcaagcctctgacctggttgcaattcttccatcatttgggggcaccgatggatatgtggctgttctataattaccgaaatgaagctgtttggatttttgtgctgttgaatggtttcatccactggatcatgtacggttattattggaccagattgatcaagctgaagttccccatgccaaaatccctgattacatcaatgcagatcattcaattcaatgttggtttctacattgtctggaagtacaggaacattccctgttatcgccaagatgggatgaggatgtttggctggttcttcaattacttttatgttggcacagtcttgtgtttgttcttgaatttctatgtgcaaacgtatatcgtcaggaagcacaagggagccaaaaagattcagcccgcccgtccagctggactcccgccggccacgtactacgactccctggcagtgagcggccgcaccatggtgaaaaggccagcacttccgctgaccgttgatggtgtcacctatgatgtgtctgcctggttgaaccatcatccagggggtgctgacatcattgagaactaccgcggtcgtgatgccactgatgtctttatggttatgcactctgaaaatgctgtgagtaaactaagaaggatgcctatcatggaaccatcatctccactgacgcctacgccaccgaaacccaactcagacgaaccgcaggaggatttccgcaagctccgagatgagctcatcgcagcaggaatgttcgacgcatcaccgatgtggtacgcatataagacgctcagtacgctgggcctcggggtcctcgcggtgctattgatgacccagtggcactggtacctcgtcggggcaatcgtgttgggcattcacttccaacaaatgggttggttgtcgcacgatatctgccaccatcagctgttcaaggaccgatcgatcaacaacgccatcggcttgcttttcgggaacgtcttgcaagggttctctgtgacctggtggaaggacaggcacaatgcacaccactccgccaccaacgtgcaaggccacgaccccgacattgacaacctgccgctgctggcatggtccaaggaggacgtggagagggccggcccgttctcacggcggatgatcaagtaccagcaatactacttcttcttcatctgtgccctcctgaggttcatctggtgcttccagagcatccacacagccacgggcctgaaggatcgcagcaaccagtactaccgcaggcagtacgagaaagagagcgtgggcctggccctccactggggcctgaaggcgttgttctactacttttatatgccaagcttcttgaccggactcatggtgtttttcgtgtccgagttgcttgggggcttcggcatcgccatcgtggtgttcatgaaccactaccccctggagaagatccaggactcggtgtgggacggccacggcttttgcgccggccagattcacgaaacgatgaacgtccagcggggactcgtcacggactggttcttcggtgggctgaattaccaaatcgagcaccacctgtggccgacgctgccccggcacaacctgacggcggccagcatcaaagtggagcagttgtgcaagaagcacaacttgccgtatcgcagccccccaatgctggagggggtgggcatcctgatcagctacctgggcacctttgcccgcatggtggcaaaggccgacaaggcgtaagc

SEQ ID NO: 490 - DNA, 9190 bp, artificial
  Plasmid pKR1200
gatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatcgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttggatctcctgcaggatctggccggccggatctcgtacggatccttcatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactccatggaggtggtgaatgaaatagtctcaattgggcaggaagttttacccaaagttgattatgcccaactctggagtgatgccagtcactgtgaggtgctttacttgtccatcgcatttgtcatcttgaagttcactcttggcccccttggtccaaaaggtcagtctcgtatgaagtttgttttcaccaattacaaccttctcatgtccatttattcgttgggatcattcctctcaatggcatatgccatgtacaccatcggtgttatgtctgacaactgcgagaaggcttttgacaacaacgtcttcaggatcaccacgcagttgttctatttgagcaagttcctggagtatattgactccttctatttgccactgatgggcaagcctctgacctggttgcaattcttccatcatttgggggcaccgatggatatgtggctgttctataattaccgaaatgaagctgtttggatttttgtgctgttgaatggtttcatccactggatcatgtacggttattattggaccagattgatcaagctgaagttccccatgccaaaatccctgattacatcaatgcagatcattcaattcaatgttggtttctacattgtctggaagtacaggaacattccctgttatcgccaagatgggatgaggatgtttggctggttcttcaattacttttatgttggcacagtcttgtgtttgttcttgaatttctatgtgcaaacgtatatcgtcaggaagcacaagggagccaaaaagattcagcccgcccgtccagctggactcccgccggccacgtactacgactccctggcagtgagcggccgcaccatggtgaaaaggccagcacttccgctgaccgttgatggtgtcacctatgatgtgtctgcctggttgaaccatcatccagggggtgctgacatcattgagaactaccgcggtcgtgatgccactgatgtctttatggttatgcactctgaaaatgctgtgagtaaactaagaaggatgcctatcatggaaccatcatctccactgacgcctacgccaccgaaacccaactcagacgaaccgcaggaggatttccgcaagctccgagatgagctcatcgcagcaggaatgttcgacgcatcaccgatgtggtacgcatataagacgctcagtacgctgggcctcggggtcctcgcggtgctattgatgacccagtggcactggtacctcgtcggggcaatcgtgttgggcattcacttccaacaaatgggttggttgtcgcacgatatctgccaccatcagctgttcaaggaccgatcgatcaacaacgccatcggcttgcttttcgggaacgtcttgcaagggttctctgtgacctggtggaaggacaggcacaatgcacaccactccgccaccaacgtgcaaggccacgaccccgacattgacaacctgccgctgctggcatggtccaaggaggacgtggagagggccggcccgttctcacggcggatgatcaagtaccagcaatactacttcttcttcatctgtgccctcctgaggttcatctggtgcttccagagcatccacacagccacgggcctgaaggatcgcagcaaccagtactaccgcaggcagtacgagaaagagagcgtgggcctggccctccactggggcctgaaggcgttgttctactacttttatatgccaagcttcttgaccggactcatggtgtttttcgtgtccgagttgcttgggggcttcggcatcgccatcgtggtgttcatgaaccactaccccctggagaagatccaggactcggtgtgggacggccacggcttttgcgccggccagattcacgaaacgatgaacgtccagcggggactcgtcacggactggttcttcggtgggctgaattaccaaatcgagcaccacctgtggccgacgctgccccggcacaacctgacggcggccagcatcaaagtggagcagttgtgcaagaagcacaacttgccgtatcgcagccccccaatgctggagggggtgggcatcctgatcagctacctgggcacctttgcccgcatggtggcaaaggccgacaaggcgtaagcggccgcaagtatgaactaaaatgcacgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaaggaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtaaagcaatggttgaccgtgtgcttagcttcttttattttatttttttatcagcaaagaataaataaaataaaatgagacacttcagggatgtttcaacg

SEQ ID NO: 491 - DNA, 9190 bp, artificial
  Plasmid pKR1184
ggccgcaagtatgaactaaaatgcacgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaaggaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtaaagcaatggttgaccgtgtgcttagcttcttttattttatttttttatcagcaaagaataaataaaataaaatgagacacttcagggatgtttcaacggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatcgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttggatctcctgcaggatctggccggccggatctcgtacggatccttcatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactccatggaagcagccaaagaattggtttccatcgtccaagaggagctccccaaggtggactatgcccagctttggcaggatgccagcagctgtgaggtcctttacctctcggtggcattcgtggcgatcaagttcatgctgcgcccactggacctgaagcgccaggccaccttgaagaagctgttcacagcatacaacttcctcatgtcgatctattcctttggctccttcctggccatggcctatgccctatcagtaactggcatcctctccggcgactgtgagacggcgttcaacaacgatgtgttcaggatcacaactcagctgttctacctcagcaagttcgtagagtacatcgactccttctaccttccccttatggacaagccactgtcgttccttcagttcttccatcatttgggggcccccattgacatgtggctattctacaaataccgcaacgaaggagtctggatctttgtcctgttgaatgggttcattcactggatcatgtacggttactattggacgcggctcatcaagctgaacttccccatgcccaagaacctgatcacctccatgcagatcatccagttcaatgtcgggttctacatcgtctggaagtaccgcaatgtgccatgctaccgccaggatgggatgcgcatgtttgcctggatcttcaactactggtatgtcgggacggtcttgctgctgttcctcaacttttacgtgcagacgtacatccggaagccgaggaagaaccgagggaagaaggagcccgcccgtccagctggactcccgccggccacgtactacgactccctggcagtgagcggccgcaccatggtgaaaaggccagcacttccgctgaccgttgatggtgtcacctatgatgtgtctgcctggttgaaccatcatccagggggtgctgacatcattgagaactaccgcggtcgtgatgccactgatgtctttatggttatgcactctgaaaatgctgtgagtaaactaagaaggatgcctatcatggaaccatcatctccactgacgcctacgccaccgaaacccaactcagacgaaccgcaggaggatttccgcaagctccgagatgagctcatcgcagcaggaatgttcgacgcatcaccgatgtggtacgcatataagacgctcagtacgctgggcctcggggtcctcgcggtgctattgatgacccagtggcactggtacctcgtcggggcaatcgtgttgggcattcacttccaacaaatgggttggttgtcgcacgatatctgccaccatcagctgttcaaggaccgatcgatcaacaacgccatcggcttgcttttcgggaacgtcttgcaagggttctctgtgacctggtggaaggacaggcacaatgcacaccactccgccaccaacgtgcaaggccacgaccccgacattgacaacctgccgctgctggcatggtccaaggaggacgtggagagggccggcccgttctcacggcggatgatcaagtaccagcaatactacttcttcttcatctgtgccctcctgaggttcatctggtgcttccagagcatccacacagccacgggcctgaaggatcgcagcaaccagtactaccgcaggcagtacgagaaagagagcgtgggcctggccctccactggggcctgaaggcgttgttctactacttttatatgccaagcttcttgaccggactcatggtgtttttcgtgtccgagttgcttgggggcttcggcatcgccatcgtggtgttcatgaaccactaccccctggagaagatccaggactcggtgtgggacggccacggcttttgcgccggccagattcacgaaacgatgaacgtccagcggggactcgtcacggactggttcttcggtgggctgaattaccaaatcgagcaccacctgtggccgacgctgccccggcacaacctgacggcggccagcatcaaagtggagcagttgtgcaagaagcacaacttgccgtatcgcagccccccaatgctggagggggtgggcatcctgatcagctacctgggcacctttgcccgcatggtggcaaaggccgacaaggcgtaagc

SEQ ID NO: 492 - DNA, 2103 bp, artificial
  EgD9e/TpomD8 fusion
atggaggtggtgaatgaaatagtctcaattgggcaggaagttttacccaaagttgattatgcccaactctggagtgatgccagtcactgtgaggtgctttacttgtccatcgcatttgtcatcttgaagttcactcttggcccccttggtccaaaaggtcagtctcgtatgaagtttgttttcaccaattacaaccttctcatgtccatttattcgttgggatcattcctctcaatggcatatgccatgtacaccatcggtgttatgtctgacaactgcgagaaggcttttgacaacaacgtcttcaggatcaccacgcagttgttctatttgagcaagttcctggagtatattgactccttctatttgccactgatgggcaagcctctgacctggttgcaattcttccatcatttgggggcaccgatggatatgtggctgttctataattaccgaaatgaagctgtttggatttttgtgctgttgaatggtttcatccactggatcatgtacggttattattggaccagattgatcaagctgaagttccccatgccaaaatccctgattacatcaatgcagatcattcaattcaatgttggtttctacattgtctggaagtacaggaacattccctgttatcgccaagatgggatgaggatgtttggctggttcttcaattacttttatgttggcacagtcttgtgtttgttcttgaatttctatgtgcaaacgtatatcgtcaggaagcacaagggagccaaaaagattcagcccgcccgtccagctggactcccgccggccacgtactacgactccctggcagtgagcggccgcaccatgtctcctaagcggcaagctctgccaatcacaattgatggcgcaacttatgatgtgtctgcttgggtcaatcaccaccctggaggagctgacattatcgagaactatcgcaaccgcgatgcgaccgatgtcttcatggtgatgcactctcaagaagccgtcgccaagttgaagagaatgcctgttatggagccttcctctcctgacacacctgttgcacccaagcctaagcgtgatgagccccaggaggatttccgcaagttgcgggaggaattcatctccaagggtatgttcgagacgagtttcctttggtatttttacaagacttcaactaccgtcggtttgatggtcctttccatcttgatgaccgtgtacacgaattggtatttcaccgctgctttggttcttggcgtgtgctaccaacagctaggctggttgtcccacgactattgccatcaccaggttttcacaaaccgcaagattaacgacgctttcggtctctttttcggtaacgtgatgcagggatactcacagacttggtggaaggataggcacaatggtcaccatgccgccaccaatgtggtcggccatgacccagatattgataacctccccatcctggcttggtctcccgaagatgtcaagagggctactccttcgactcggaatctcatcaagtaccagcagtactacttcattcccaccattgcatcccttaggttcatctggtgcctccaatccatcggcggcgtcatgtcctacaagagcgaggagaggaacctgtactacaagcgccagtacactaaggaggcgattggtctggccctccactgggtgctcaaggccactttctattgcagtgccatgcctagctttgccaccggtttgggatgcttcttgatctccgagctgctcggaggatttggcattgccatcgttgtgtttctgaatcactatcctttggacaaggttgaggagactgtctgggatgagcacgggttcagcgccagccagatccacgagacgttgaacattaagcccggccttctcaccgattgggtctttggtggtctcaactaccagattgagcaccacttgtggcccaacatgcccaggcacaacctcacggcagcttccctggaggtgcagaagttgtgcgccaagcacaacctgccctacagggccccagccatcatccccggggttcagaaattggtcagcttcttaggcgagattgcccagctggctgctgtccctgaatga

SEQ ID NO: 493 - DNA, 2103 bp, artificial
  EgD9e/EaD8 fusion
atggaggtggtgaatgaaatagtctcaattgggcaggaagttttacccaaagttgattatgcccaactctggagtgatgccagtcactgtgaggtgctttacttgtccatcgcatttgtcatcttgaagttcactcttggcccccttggtccaaaaggtcagtctcgtatgaagtttgttttcaccaattacaaccttctcatgtccatttattcgttgggatcattcctctcaatggcatatgccatgtacaccatcggtgttatgtctgacaactgcgagaaggcttttgacaacaacgtcttcaggatcaccacgcagttgttctatttgagcaagttcctggagtatattgactccttctatttgccactgatgggcaagcctctgacctggttgcaattcttccatcatttgggggcaccgatggatatgtggctgttctataattaccgaaatgaagctgtttggatttttgtgctgttgaatggtttcatccactggatcatgtacggttattattggaccagattgatcaagctgaagttccccatgccaaaatccctgattacatcaatgcagatcattcaattcaatgttggtttctacattgtctggaagtacaggaacattccctgttatcgccaagatgggatgaggatgtttggctggttcttcaattacttttatgttggcacagtcttgtgtttgttcttgaatttctatgtgcaaacgtatatcgtcaggaagcacaagggagccaaaaagattcagcccgcccgtccagctggactcccgccggccacgtactacgactccctggcagtgagcggccgcaccatggtgaaaaggccagcacttccgctgaccgttgatggtgtcacctatgatgtgtctgcctggttgaaccatcatccagggggtgctgacatcattgagaactaccgcggtcgtgatgccactgatgtctttatggttatgcactctgaaaatgctgtgagtaaactaagaaggatgcctatcatggaaccatcatctccactgacgcctacgccaccgaaacccaactcagacgaaccgcaggaggatttccgcaagctccgagatgagctcatcgcagcaggaatgttcgacgcatcaccgatgtggtacgcatataagacgctcagtacgctgggcctcggggtcctcgcggtgctattgatgacccagtggcactggtacctcgtcggggcaatcgtgttgggcattcacttccaacaaatgggttggttgtcgcacgatatctgccaccatcagctgttcaaggaccgatcgatcaacaacgccatcggcttgcttttcgggaacgtcttgcaagggttctctgtgacctggtggaaggacaggcacaatgcacaccactccgccaccaacgtgcaaggccacgaccccgacattgacaacctgccgctgctggcatggtccaaggaggacgtggagagggccggcccgttctcacggcggatgatcaagtaccagcaatactacttcttcttcatctgtgccctcctgaggttcatctggtgcttccagagcatccacacagccacgggcctgaaggatcgcagcaaccagtactaccgcaggcagtacgagaaagagagcgtgggcctggccctccactggggcctgaaggcgttgttctactacttttatatgccaagcttcttgaccggactcatggtgtttttcgtgtccgagttgcttgggggcttcggcatcgccatcgtggtgttcatgaaccactaccccctggagaagatccaggactcggtgtgggacggccacggcttttgcgccggccagattcacgaaacgatgaacgtccagcggggactcgtcacggactggttcttcggtgggctgaattaccaaatcgagcaccacctgtggccgacgctgccccggcacaacctgacggcggccagcatcaaagtggagcagttgtgcaagaagcacaacttgccgtatcgcagccccccaatgctggagggggtgggcatcctgatcagctacctgggcacctttgcccgcatggtggcaaaggccgacaaggcgtaa

SEQ ID NO: 494 - DNA, 2103 bp, artificial
  EaD9e/TpomD8 fusion
atggaagcagccaaagaattggtttccatcgtccaagaggagctccccaaggtggactatgcccagctttggcaggatgccagcagctgtgaggtcctttacctctcggtggcattcgtggcgatcaagttcatgctgcgcccactggacctgaagcgccaggccaccttgaagaagctgttcacagcatacaacttcctcatgtcgatctattcctttggctccttcctggccatggcctatgccctatcagtaactggcatcctctccggcgactgtgagacggcgttcaacaacgatgtgttcaggatcacaactcagctgttctacctcagcaagttcgtagagtacatcgactccttctaccttccccttatggacaagccactgtcgttccttcagttcttccatcatttgggggcccccattgacatgtggctattctacaaataccgcaacgaaggagtctggatctttgtcctgttgaatgggttcattcactggatcatgtacggttactattggacgcggctcatcaagctgaacttccccatgcccaagaacctgatcacctccatgcagatcatccagttcaatgtcgggttctacatcgtctggaagtaccgcaatgtgccatgctaccgccaggatgggatgcgcatgtttgcctggatcttcaactactggtatgtcgggacggtcttgctgctgttcctcaacttttacgtgcagacgtacatccggaagccgaggaagaaccgagggaagaaggagcccgcccgtccagctggactcccgccggccacgtactacgactccctggcagtgagcggccgcaccatgtctcctaagcggcaagctctgccaatcacaattgatggcgcaacttatgatgtgtctgcttgggtcaatcaccaccctggaggagctgacattatcgagaactatcgcaaccgcgatgcgaccgatgtcttcatggtgatgcactctcaagaagccgtcgccaagttgaagagaatgcctgttatggagccttcctctcctgacacacctgttgcacccaagcctaagcgtgatgagccccaggaggatttccgcaagttgcgggaggaattcatctccaagggtatgttcgagacgagtttcctttggtatttttacaagacttcaactaccgtcggtttgatggtcctttccatcttgatgaccgtgtacacgaattggtatttcaccgctgctttggttcttggcgtgtgctaccaacagctaggctggttgtcccacgactattgccatcaccaggttttcacaaaccgcaagattaacgacgctttcggtctctttttcggtaacgtgatgcagggatactcacagacttggtggaaggataggcacaatggtcaccatgccgccaccaatgtggtcggccatgacccagatattgataacctccccatcctggcttggtctcccgaagatgtcaagagggctactccttcgactcggaatctcatcaagtaccagcagtactacttcattcccaccattgcatcccttaggttcatctggtgcctccaatccatcggcggcgtcatgtcctacaagagcgaggagaggaacctgtactacaagcgccagtacactaaggaggcgattggtctggccctccactgggtgctcaaggccactttctattgcagtgccatgcctagctttgccaccggtttgggatgcttcttgatctccgagctgctcggaggatttggcattgccatcgttgtgtttctgaatcactatcctttggacaaggttgaggagactgtctgggatgagcacgggttcagcgccagccagatccacgagacgttgaacattaagcccggccttctcaccgattgggtctttggtggtctcaactaccagattgagcaccacttgtggcccaacatgcccaggcacaacctcacggcagcttccctggaggtgcagaagttgtgcgccaagcacaacctgccctacagggccccagccatcatccccggggttcagaaattggtcagcttcttaggcgagattgcccagctggctgctgtccctgaatga

SEQ ID NO: 495 - DNA, 2103 bp, artificial
  EaD9e/EaD8 fusion
atggaagcagccaaagaattggtttccatcgtccaagaggagctccccaaggtggactatgcccagctttggcaggatgccagcagctgtgaggtcctttacctctcggtggcattcgtggcgatcaagttcatgctgcgcccactggacctgaagcgccaggccaccttgaagaagctgttcacagcatacaacttcctcatgtcgatctattcctttggctccttcctggccatggcctatgccctatcagtaactggcatcctctccggcgactgtgagacggcgttcaacaacgatgtgttcaggatcacaactcagctgttctacctcagcaagttcgtagagtacatcgactccttctaccttccccttatggacaagccactgtcgttccttcagttcttccatcatttgggggcccccattgacatgtggctattctacaaataccgcaacgaaggagtctggatctttgtcctgttgaatgggttcattcactggatcatgtacggttactattggacgcggctcatcaagctgaacttccccatgcccaagaacctgatcacctccatgcagatcatccagttcaatgtcgggttctacatcgtctggaagtaccgcaatgtgccatgctaccgccaggatgggatgcgcatgtttgcctggatcttcaactactggtatgtcgggacggtcttgctgctgttcctcaacttttacgtgcagacgtacatccggaagccgaggaagaaccgagggaagaaggagcccgcccgtccagctggactcccgccggccacgtactacgactccctggcagtgagcggccgcaccatggtgaaaaggccagcacttccgctgaccgttgatggtgtcacctatgatgtgtctgcctggttgaaccatcatccagggggtgctgacatcattgagaactaccgcggtcgtgatgccactgatgtctttatggttatgcactctgaaaatgctgtgagtaaactaagaaggatgcctatcatggaaccatcatctccactgacgcctacgccaccgaaacccaactcagacgaaccgcaggaggatttccgcaagctccgagatgagctcatcgcagcaggaatgttcgacgcatcaccgatgtggtacgcatataagacgctcagtacgctgggcctcggggtcctcgcggtgctattgatgacccagtggcactggtacctcgtcggggcaatcgtgttgggcattcacttccaacaaatgggttggttgtcgcacgatatctgccaccatcagctgttcaaggaccgatcgatcaacaacgccatcggcttgcttttcgggaacgtcttgcaagggttctctgtgacctggtggaaggacaggcacaatgcacaccactccgccaccaacgtgcaaggccacgaccccgacattgacaacctgccgctgctggcatggtccaaggaggacgtggagagggccggcccgttctcacggcggatgatcaagtaccagcaatactacttcttcttcatctgtgccctcctgaggttcatctggtgcttccagagcatccacacagccacgggcctgaaggatcgcagcaaccagtactaccgcaggcagtacgagaaagagagcgtgggcctggccctccactggggcctgaaggcgttgttctactacttttatatgccaagcttcttgaccggactcatggtgtttttcgtgtccgagttgcttgggggcttcggcatcgccatcgtggtgttcatgaaccactaccccctggagaagatccaggactcggtgtgggacggccacggcttttgcgccggccagattcacgaaacgatgaacgtccagcggggactcgtcacggactggttcttcggtgggctgaattaccaaatcgagcaccacctgtggccgacgctgccccggcacaacctgacggcggccagcatcaaagtggagcagttgtgcaagaagcacaacttgccgtatcgcagccccccaatgctggagggggtgggcatcctgatcagctacctgggcacctttgcccgcatggtggcaaaggccgacaaggcgtaa

SEQ ID NO: 496 - DNA, 2112 bp, artificial
  EgD9e/PavD8 fusion
atggaggtggtgaatgaaatagtctcaattgggcaggaagttttacccaaagttgattatgcccaactctggagtgatgccagtcactgtgaggtgctttacttgtccatcgcatttgtcatcttgaagttcactcttggcccccttggtccaaaaggtcagtctcgtatgaagtttgttttcaccaattacaaccttctcatgtccatttattcgttgggatcattcctctcaatggcatatgccatgtacaccatcggtgttatgtctgacaactgcgagaaggcttttgacaacaacgtcttcaggatcaccacgcagttgttctatttgagcaagttcctggagtatattgactccttctatttgccactgatgggcaagcctctgacctggttgcaattcttccatcatttgggggcaccgatggatatgtggctgttctataattaccgaaatgaagctgtttggatttttgtgctgttgaatggtttcatccactggatcatgtacggttattattggaccagattgatcaagctgaagttccccatgccaaaatccctgattacatcaatgcagatcattcaattcaatgttggtttctacattgtctggaagtacaggaacattccctgttatcgccaagatgggatgaggatgtttggctggttcttcaattacttttatgttggcacagtcttgtgtttgttcttgaatttctatgtgcaaacgtatatcgtcaggaagcacaagggagccaaaaagattcagcccgcccgtccagctggactcccgccggccacgtactacgactccctggcagtgagcggccgcaccatgggcaagggtggagacggcggcgcgcaggcggtgagcgggaccgacgcgtctctcgctgaggtgagctccgtcgatagcaagagcgtgcacgtcgtgctctacggcaagcgcgtggatgtcacaaagttccagaaggcacacccgggcgggagcaaggtgttccgcatcttccaggagcgcgacgcgacggagcagttcgagtcttaccactcgcccaaggccatcaagatgatggagggcatgctcaagaagtcggaggatgcgcccgcttccgtgcccctgccctcgcggtccaccatgggcacggagttcaaggagatgattgagcgccacaagagggctggtctctacgacccttgcccgttggacgagctgttcaagctcaccatcgtccttgcgcccatcttcgtgggcgcctatctcgtgcggagcggcgtctcgcccctcgcgggcgcgctctccatgggctttggcttctacctcgacggctggcttgctcacgactacctgcatcacgcagtcttcaagggctcggtcaacacgctcgtcaaggcgaacaacgccatgggatacgccctcggcttcctccagggctacgacgtggcctggtggcgcgcgcgccataacacgcaccacgtgtgcaccaacgaggatggttcggacccggacatcaagacggcgcccctgctcatctacgtgcgagagaacccgtccattgccaagcggctcaacttcttccagcgctggcagcagtactactatgtgccgaccatggccatcctcgacctctactggcgcctggagtccatcgcgtacgtggctgtgcgcctgcctaagatgtggatgcaggccgccgctcttgccgctcactacgcgctcctgtgctgggtcttcgcagcgcatctcaacctcatccctctcatgatggttgcacgcggcttcgcgacgggcatcgttgtctttgcaacccactatggtgaggacatcctcgaccgcgagcacgtcgagggcatgacgctcgtcgagcagaccgccaagacctcccgtaacatcacgggcggctggctagtgaacgtgctcacgggcttcatctccctgcagaccgagcatcacctcttccccatgatgcccaccggcaacctaatgactatccagcccgaggtacgcgacttcttcaagaagcatggcctcgagtaccgcgagggcaacctcttccagtgcgtgcaccagaacatcaaggctctcgccttcgagcacctcctccactga

SEQ ID NO: 497 - DNA, 3967 bp, artificial
  Plasmid pKR1303
aattcatctccaagggtatgttcgagacgagtttcctttggtatttttacaagacttcaactaccgtcggtttgatggtcctttccatcttgatgaccgtgtacacgaattggtatttcaccgctgctttggttcttggcgtgtgctaccaacagctaggctggttgtcccacgactattgccatcaccaggttttcacaaaccgcaagattaacgacgctttcggtctctttttcggtaacgtgatgcagggatactcacagacttggtggaaggataggcacaatggtcaccatgccgccaccaatgtggtcggccatgacccagatattgataacctccccatcctggcttggtctcccgaagatgtcaagagggctactccttcgactcggaatctcatcaagtaccagcagtactacttcattcccaccattgcatcccttaggttcatctggtgcctccaatccatcggcggcgtcatgtcctacaagagcgaggagaggaacctgtactacaagcgccagtacactaaggaggcgattggtctggccctccactgggtgctcaaggccactttctattgcagtgccatgcctagctttgccaccggtttgggatgcttcttgatctccgagctgctcggaggatttggcattgccatcgttgtgtttctgaatcactatcctttggacaaggttgaggagactgtctgggatgagcacgggttcagcgccagccagatccacgagacgttgaacattaagcccggccttctcaccgattgggtctttggtggtctcaactaccagattgagcaccacttgtggcccaacatgcccaggcacaacctcacggcagcttccctggaggtgcagaagttgtgcgccaagcacaacctgccctacagggccccagccatcatccccggggttcagaaattggtcagcttcttaggcgagattgcccagctggctgctgtccctgaacccgcccgtccagctggactcccgccggccacgtactacgactccctggcagtgtccggccgccaccgcggtggagctccagcttttgttccctttagtgagggttaatttcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgacggtatcgataagcttgatatcg

SEQ ID NO: 498 - DNA, 4754 bp, artificial
  Plasmid pKR1308
ggccgccaccgcggtggagctccagcttttgttccctttagtgagggttaatttcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgacggtatcgataagcttgatatcgaattcatctccaagggtatgttcgagacgagtttcctttggtatttttacaagacttcaactaccgtcggtttgatggtcctttccatcttgatgaccgtgtacacgaattggtatttcaccgctgctttggttcttggcgtgtgctaccaacagctaggctggttgtcccacgactattgccatcaccaggttttcacaaaccgcaagattaacgacgctttcggtctctttttcggtaacgtgatgcagggatactcacagacttggtggaaggataggcacaatggtcaccatgccgccaccaatgtggtcggccatgacccagatattgataacctccccatcctggcttggtctcccgaagatgtcaagagggctactccttcgactcggaatctcatcaagtaccagcagtactacttcattcccaccattgcatcccttaggttcatctggtgcctccaatccatcggcggcgtcatgtcctacaagagcgaggagaggaacctgtactacaagcgccagtacactaaggaggcgattggtctggccctccactgggtgctcaaggccactttctattgcagtgccatgcctagctttgccaccggtttgggatgcttcttgatctccgagctgctcggaggatttggcattgccatcgttgtgtttctgaatcactatcctttggacaaggttgaggagactgtctgggatgagcacgggttcagcgccagccagatccacgagacgttgaacattaagcccggccttctcaccgattgggtctttggtggtctcaactaccagattgagcaccacttgtggcccaacatgcccaggcacaacctcacggcagcttccctggaggtgcagaagttgtgcgccaagcacaacctgccctacagggccccagccatcatccccggggttcagaaattggtcagcttcttaggcgagattgcccagctggctgctgtccctgaacccgcccgtccagctggactcccgccggccacgtactacgactccctggcagtgtccggccgcaccatggaagcagccaaagaattggtttccatcgtccaagaggagctccccaaggtggactatgcccagctttggcaggatgccagcagctgtgaggtcctttacctctcggtggcattcgtggcgatcaagttcatgctgcgcccactggacctgaagcgccaggccaccttgaagaagctgttcacagcatacaacttcctcatgtcgatctattcctttggctccttcctggccatggcctatgccctatcagtaactggcatcctctccggcgactgtgagacggcgttcaacaacgatgtgttcaggatcacaactcagctgttctacctcagcaagttcgtagagtacatcgactccttctaccttccccttatggacaagccactgtcgttccttcagttcttccatcatttgggggcccccattgacatgtggctattctacaaataccgcaacgaaggagtctggatctttgtcctgttgaatgggttcattcactggatcatgtacggttactattggacgcggctcatcaagctgaacttccccatgcccaagaacctgatcacctccatgcagatcatccagttcaatgtcgggttctacatcgtctggaagtaccgcaatgtgccatgctaccgccaggatgggatgcgcatgtttgcctggatcttcaactactggtatgtcgggacggtcttgctgctgttcctcaacttttacgtgcagacgtacatccggaagccgaggaagaaccgagggaagaaggagtagc

SEQ ID NO: 499 - DNA, 5250 bp, artificial
  Plasmid pKR393
gatcccccgggctgcaggaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgcggccgccaattcaggtgcccatgatgttggccgcaggctatcttctagtgctctcggccgctcgccagagcttccagcaggacattgacaaccccaacggggcctactcgacctcgtggactggcctgcccattgtgatgtctgtggtctatctcagcggtgtgtttgggctcacaaagtacttcgagaaccggaagcccatgacggggctgaaggactacatgttcacttacaatctctaccaggtgatcatcaacgtgtggtgcgtggtggcctttctcctggaggtgcggcgtgcgggcatgtcactcatcggcaataaggtggaccttgggcccaactccttcaggctcggcttcgtcacgtgggtgcactacaacaacaagtacgtggagctcctcgacaccctatggatggtgctgcgcaagaagacgcagcaggtctccttcctccacgtctatcatcacgtgcttctgatgtgggcctggttcgttgtcgtcaagctcggcaatggtggtgacgcatattttggcggtctcatgaactcgatcatccacgtgatgatgtattcctactacaccatggcgctcctgggctggtcatgcccctggaagcgctacctcacgcaggcacagctcgtgcagttttgcatctgcctcgcccactccacatgggcggcagtaacgggtgcctacccgtggcgaatttgcttggtggaggtgtgggtgatggtgtccatgctggtgctcttcacacgcttctaccgccaggcctatgccaaggaggcgaaggccaaggaggcgaaaaagctcgcacaggaggcatcacaggccaaggcggtcaaggcggagtaagtcactggaggtggaccgcacatgcaccacgggcccggcgagcagcatggttcggcgagtcaggcccggtcatgcgtcatggttggagtttgcagggcggcaggtgatcgcctccgccatgcacggccacaggcacagccggtcctctggacgtcccaactttcaaccgtggtgcaaagcacgctggcgaccgcgagcagcagtcagcgcagcgtgttatcacagtgtcgctggctgcacgtgctctctccatcgcggccgcatttcgcaccaaatcaatgaaagtaataatgaaaagtctgaataagaatacttaggcttagatgcctttgttacttgtgtaaaataacttgagtcatgtacctttggcggaaacagaataaataaaaggtgaaattccaatgctctatgtataagttagtaatacttaatgtgttctacggttgtttcaatatcatcaaactctaattgaaactttagaaccacaaatctcaatcttttcttaatgaaatgaaaaatcttaattgtaccatgtttatgttaaacaccttacaattggttggagaggaggaccaaccgatgggacaacattgggagaaagagattcaatggagatttggataggagaacaacattctttttcacttcaatacaagatgagtgcaacactaaggatatgtatgagactttcagaagctacgacaacatagatgagtgaggtggtgattcctagcaagaaagacattagaggaagccaaaatcgaacaaggaagacatcaagggcaagagacaggaccatccatctcaggaaaaggagctttgggatagtccgagaagttgtacaagaaattttttggagggtgagtgatgcattgctggtgactttaactcaatcaaaattgagaaagaaagaaaagggagggggctcacatgtgaatagaagggaaacgggagaattttacagttttgatctaatgggcatcccagctagtggtaacatattcaccatgtttaaccttcacgtacgtctagag

SEQ ID NO: 500 - DNA, 4140 bp, artificial
  Plasmid pKR407
ggccgcatttcgcaccaaatcaatgaaagtaataatgaaaagtctgaataagaatacttaggcttagatgcctttgttacttgtgtaaaataacttgagtcatgtacctttggcggaaacagaataaataaaaggtgaaattccaatgctctatgtataagttagtaatacttaatgtgttctacggttgtttcaatatcatcaaactctaattgaaactttagaaccacaaatctcaatcttttcttaatgaaatgaaaaatcttaattgtaccatgtttatgttaaacaccttacaattggttggagaggaggaccaaccgatgggacaacattgggagaaagagattcaatggagatttggataggagaacaacattctttttcacttcaatacaagatgagtgcaacactaaggatatgtatgagactttcagaagctacgacaacatagatgagtgaggtggtgattcctagcaagaaagacattagaggaagccaaaatcgaacaaggaagacatcaagggcaagagacaggaccatccatctcaggaaaaggagctttgggatagtccgagaagttgtacaagaaattttttggagggtgagtgatgcattgctggtgactttaactcaatcaaaattgagaaagaaagaaaagggagggggctcacatgtgaatagaagggaaacgggagaattttacagttttgatctaatgggcatcccagctagtggtaacatattcaccatgtttaaccttcacgtacgtctagaggatcccccgggctgcaggaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgc

SEQ ID NO: 501 - DNA, 5414 bp, artificial
  Plasmid pKR1018
ggccgcatttcgcaccaaatcaatgaaagtaataatgaaaagtctgaataagaatacttaggcttagatgcctttgttacttgtgtaaaataacttgagtcatgtacctttggcggaaacagaataaataaaaggtgaaattccaatgctctatgtataagttagtaatacttaatgtgttctacggttgtttcaatatcatcaaactctaattgaaactttagaaccacaaatctcaatcttttcttaatgaaatgaaaaatcttaattgtaccatgtttatgttaaacaccttacaattggttggagaggaggaccaaccgatgggacaacattgggagaaagagattcaatggagatttggataggagaacaacattctttttcacttcaatacaagatgagtgcaacactaaggatatgtatgagactttcagaagctacgacaacatagatgagtgaggtggtgattcctagcaagaaagacattagaggaagccaaaatcgaacaaggaagacatcaagggcaagagacaggaccatccatctcaggaaaaggagctttgggatagtccgagaagttgtacaagaaattttttggagggtgagtgatgcattgctggtgactttaactcaatcaaaattgagaaagaaagaaaagggagggggctcacatgtgaatagaagggaaacgggagaattttacagttttgatctaatgggcatcccagctagtggtaacatattcaccatgtttaaccttcacgtacgtctagaggatcccccgggctgcaggaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgcggccgcaccatgtctcctaagcggcaagctctgccaatcacaattgatggcgcaacttatgatgtgtctgcttgggtcaatcaccaccctggaggagctgacattatcgagaactatcgcaaccgcgatgcgaccgatgtcttcatggtgatgcactctcaagaagccgtcgccaagttgaagagaatgcctgttatggagccttcctctcctgacacacctgttgcacccaagcctaagcgtgatgagccccaggaggatttccgcaagttgcgggaggaattcatctccaagggtatgttcgagacgagtttcctttggtatttttacaagacttcaactaccgtcggtttgatggtcctttccatcttgatgaccgtgtacacgaattggtatttcaccgctgctttggttcttggcgtgtgctaccaacagctaggctggttgtcccacgactattgccatcaccaggttttcacaaaccgcaagattaacgacgctttcggtctctttttcggtaacgtgatgcagggatactcacagacttggtggaaggataggcacaatggtcaccatgccgccaccaatgtggtcggccatgacccagatattgataacctccccatcctggcttggtctcccgaagatgtcaagagggctactccttcgactcggaatctcatcaagtaccagcagtactacttcattcccaccattgcatcccttaggttcatctggtgcctccaatccatcggcggcgtcatgtcctacaagagcgaggagaggaacctgtactacaagcgccagtacactaaggaggcgattggtctggccctccactgggtgctcaaggccactttctattgcagtgccatgcctagctttgccaccggtttgggatgcttcttgatctccgagctgctcggaggatttggcattgccatcgttgtgtttctgaatcactatcctttggacaaggttgaggagactgtctgggatgagcacgggttcagcgccagccagatccacgagacgttgaacattaagcccggccttctcaccgattgggtctttggtggtctcaactaccagattgagcaccacttgtggcccaacatgcccaggcacaacctcacggcagcttccctggaggtgcagaagttgtgcgccaagcacaacctgccctacagggccccagccatcatccccggggttcagaaattggtcagcttcttaggcgagattgcccagctggctgctgtccctgaatgagc

SEQ ID NO: 502 - DNA, 5731 bp, artificial
  Plasmid pKR1312
aattcatctccaagggtatgttcgagacgagtttcctttggtatttttacaagacttcaactaccgtcggtttgatggtcctttccatcttgatgaccgtgtacacgaattggtatttcaccgctgctttggttcttggcgtgtgctaccaacagctaggctggttgtcccacgactattgccatcaccaggttttcacaaaccgcaagattaacgacgctttcggtctctttttcggtaacgtgatgcagggatactcacagacttggtggaaggataggcacaatggtcaccatgccgccaccaatgtggtcggccatgacccagatattgataacctccccatcctggcttggtctcccgaagatgtcaagagggctactccttcgactcggaatctcatcaagtaccagcagtactacttcattcccaccattgcatcccttaggttcatctggtgcctccaatccatcggcggcgtcatgtcctacaagagcgaggagaggaacctgtactacaagcgccagtacactaaggaggcgattggtctggccctccactgggtgctcaaggccactttctattgcagtgccatgcctagctttgccaccggtttgggatgcttcttgatctccgagctgctcggaggatttggcattgccatcgttgtgtttctgaatcactatcctttggacaaggttgaggagactgtctgggatgagcacgggttcagcgccagccagatccacgagacgttgaacattaagcccggccttctcaccgattgggtctttggtggtctcaactaccagattgagcaccacttgtggcccaacatgcccaggcacaacctcacggcagcttccctggaggtgcagaagttgtgcgccaagcacaacctgccctacagggccccagccatcatccccggggttcagaaattggtcagcttcttaggcgagattgcccagctggctgctgtccctgaacccgcccgtccagctggactcccgccggccacgtactacgactccctggcagtgtccggccgcaccatggaagcagccaaagaattggtttccatcgtccaagaggagctccccaaggtggactatgcccagctttggcaggatgccagcagctgtgaggtcctttacctctcggtggcattcgtggcgatcaagttcatgctgcgcccactggacctgaagcgccaggccaccttgaagaagctgttcacagcatacaacttcctcatgtcgatctattcctttggctccttcctggccatggcctatgccctatcagtaactggcatcctctccggcgactgtgagacggcgttcaacaacgatgtgttcaggatcacaactcagctgttctacctcagcaagttcgtagagtacatcgactccttctaccttccccttatggacaagccactgtcgttccttcagttcttccatcatttgggggcccccattgacatgtggctattctacaaataccgcaacgaaggagtctggatctttgtcctgttgaatgggttcattcactggatcatgtacggttactattggacgcggctcatcaagctgaacttccccatgcccaagaacctgatcacctccatgcagatcatccagttcaatgtcgggttctacatcgtctggaagtaccgcaatgtgccatgctaccgccaggatgggatgcgcatgtttgcctggatcttcaactactggtatgtcgggacggtcttgctgctgttcctcaacttttacgtgcagacgtacatccggaagccgaggaagaaccgagggaagaaggagtagcggccgccaccgcggtggagctccagcttttgttccctttagtgagggttaatttcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgacggtatcgataagcttgcatgcctgcaggctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgcggccgcaccatgtctcctaagcggcaagctctgccaatcacaattgatggcgcaacttatgatgtgtctgcttgggtcaatcaccaccctggaggagctgacattatcgagaactatcgcaaccgcgatgcgaccgatgtcttcatggtgatgcactctcaagaagccgtcgccaagttgaagagaatgcctgttatggagccttcctctcctgacacacctgttgcacccaagcctaagcgtgatgagccccaggaggatttccgcaagttgcgggagg

SEQ ID NO: 503 - DNA, 9198 bp, artificial
  Plasmid pKR1321
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatgtctcctaagcggcaagctctgccaatcacaattgatggcgcaacttatgatgtgtctgcttgggtcaatcaccaccctggaggagctgacattatcgagaactatcgcaaccgcgatgcgaccgatgtcttcatggtgatgcactctcaagaagccgtcgccaagttgaagagaatgcctgttatggagccttcctctcctgacacacctgttgcacccaagcctaagcgtgatgagccccaggaggatttccgcaagttgcgggaggaattcatctccaagggtatgttcgagacgagtttcctttggtatttttacaagacttcaactaccgtcggtttgatggtcctttccatcttgatgaccgtgtacacgaattggtatttcaccgctgctttggttcttggcgtgtgctaccaacagctaggctggttgtcccacgactattgccatcaccaggttttcacaaaccgcaagattaacgacgctttcggtctctttttcggtaacgtgatgcagggatactcacagacttggtggaaggataggcacaatggtcaccatgccgccaccaatgtggtcggccatgacccagatattgataacctccccatcctggcttggtctcccgaagatgtcaagagggctactccttcgactcggaatctcatcaagtaccagcagtactacttcattcccaccattgcatcccttaggttcatctggtgcctccaatccatcggcggcgtcatgtcctacaagagcgaggagaggaacctgtactacaagcgccagtacactaaggaggcgattggtctggccctccactgggtgctcaaggccactttctattgcagtgccatgcctagctttgccaccggtttgggatgcttcttgatctccgagctgctcggaggatttggcattgccatcgttgtgtttctgaatcactatcctttggacaaggttgaggagactgtctgggatgagcacgggttcagcgccagccagatccacgagacgttgaacattaagcccggccttctcaccgattgggtctttggtggtctcaactaccagattgagcaccacttgtggcccaacatgcccaggcacaacctcacggcagcttccctggaggtgcagaagttgtgcgccaagcacaacctgccctacagggccccagccatcatccccggggttcagaaattggtcagcttcttaggcgagattgcccagctggctgctgtccctgaacccgcccgtccagctggactcccgccggccacgtactacgactccctggcagtgtccggccgcaccatggaagcagccaaagaattggtttccatcgtccaagaggagctccccaaggtggactatgcccagctttggcaggatgccagcagctgtgaggtcctttacctctcggtggcattcgtggcgatcaagttcatgctgcgcccactggacctgaagcgccaggccaccttgaagaagctgttcacagcatacaacttcctcatgtcgatctattcctttggctccttcctggccatggcctatgccctatcagtaactggcatcctctccggcgactgtgagacggcgttcaacaacgatgtgttcaggatcacaactcagctgttctacctcagcaagttcgtagagtacatcgactccttctaccttccccttatggacaagccactgtcgttccttcagttcttccatcatttgggggcccccattgacatgtggctattctacaaataccgcaacgaaggagtctggatctttgtcctgttgaatgggttcattcactggatcatgtacggttactattggacgcggctcatcaagctgaacttccccatgcccaagaacctgatcacctccatgcagatcatccagttcaatgtcgggttctacatcgtctggaagtaccgcaatgtgccatgctaccgccaggatgggatgcgcatgtttgcctggatcttcaactactggtatgtcgggacggtcttgctgctgttcctcaacttttacgtgcagacgtacatccggaagccgaggaagaaccgagggaagaaggagtagc

SEQ ID NO: 504 - protein, 36 aa, artificial
  EaDHAsyn1 proline-rich linker plus 3 amino acids
PGGPGKPSEIASLPPPIRPVGNPPAAYYDALATGRT

SEQ ID NO: 505 - DNA, 35 bp, artificial
  Primer EaLink1
gcttgccggggcccccaggctccttcttccctcgg

SEQ ID NO: 506 - DNA, 35 bp, artificial
  Primer EaLink2
ccgagggaagaaggagcctgggggccccggcaagc

SEQ ID NO: 507 - DNA, 19 bp, artificial
  Primer EaLink3
ttcggccggtcgccagggc

SEQ ID NO: 508 - DNA, 894 bp, artificial
  EaD9e-EaDHAsyn1Link
agcggccgcaccatggaagcagccaaagaattggtttccatcgtccaagaggagctccccaaggtggactatgcccagctttggcaggatgccagcagctgtgaggtcctttacctctcggtggcattcgtggcgatcaagttcatgctgcgcccactggacctgaagcgccaggccaccttgaagaagctgttcacagcatacaacttcctcatgtcgatctattcctttggctccttcctggccatggcctatgccctatcagtaactggcatcctctccggcgactgtgagacggcgttcaacaacgatgtgttcaggatcacaactcagctgttctacctcagcaagttcgtagagtacatcgactccttctaccttccccttatggacaagccactgtcgttccttcagttcttccatcatttgggggcccccattgacatgtggctattctacaaataccgcaacgaaggagtctggatctttgtcctgttgaatgggttcattcactggatcatgtacggttactattggacgcggctcatcaagctgaacttccccatgcccaagaacctgatcacctccatgcagatcatccagttcaatgtcgggttctacatcgtctggaagtaccgcaatgtgccatgctaccgccaggatgggatgcgcatgtttgcctggatcttcaactactggtatgtcgggacggtcttgctgctgttcctcaacttttacgtgcagacgtacatccggaagccgaggaagaaccgagggaagaaggagcctgggggccccggcaagccaagcgagattgcgtcgctgccaccgccaattcgaccagtcgggaacccacctgcagcctactacgatgccctggcgaccggccgaacc

SEQ ID NO: 509 - DNA, 4405 bp, artificial
  Plasmid pKR1305
aattcaggagcggccgcaccatggaagcagccaaagaattggtttccatcgtccaagaggagctccccaaggtggactatgcccagctttggcaggatgccagcagctgtgaggtcctttacctctcggtggcattcgtggcgatcaagttcatgctgcgcccactggacctgaagcgccaggccaccttgaagaagctgttcacagcatacaacttcctcatgtcgatctattcctttggctccttcctggccatggcctatgccctatcagtaactggcatcctctccggcgactgtgagacggcgttcaacaacgatgtgttcaggatcacaactcagctgttctacctcagcaagttcgtagagtacatcgactccttctaccttccccttatggacaagccactgtcgttccttcagttcttccatcatttgggggcccccattgacatgtggctattctacaaataccgcaacgaaggagtctggatctttgtcctgttgaatgggttcattcactggatcatgtacggttactattggacgcggctcatcaagctgaacttccccatgcccaagaacctgatcacctccatgcagatcatccagttcaatgtcgggttctacatcgtctggaagtaccgcaatgtgccatgctaccgccaggatgggatgcgcatgtttgcctggatcttcaactactggtatgtcgggacggtcttgctgctgttcctcaacttttacgtgcagacgtacatccggaagccgaggaagaaccgagggaagaaggagcctgggggccccggcaagccaagcgagattgcgtcgctgccaccgccaattcgaccagtcgggaacccacctgcagcctactacgatgccctggcgaccggccgaacctgaattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaagcccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgtatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgccagtgtgatggatatctgcag

SEQ ID NO: 510 - DNA, 3201 bp, artificial; identical to SEQ ID NO: 310
  Plasmid pKR1317

SEQ ID NO: 511 - DNA, 5816 bp, artificial
  Plasmid pKR1320
ggccgcaccatgtctcctaagcggcaagctctgccaatcacaattgatggcgcaacttatgatgtgtctgcttgggtcaatcaccaccctggaggagctgacattatcgagaactatcgcaaccgcgatgcgaccgatgtcttcatggtgatgcactctcaagaagccgtcgccaagttgaagagaatgcctgttatggagccttcctctcctgacacacctgttgcacccaagcctaagcgtgatgagccccaggaggatttccgcaagttgcgggaggaattcatctccaagggtatgttcgagacgagtttcctttggtatttttacaagacttcaactaccgtcggtttgatggtcctttccatcttgatgaccgtgtacacgaattggtatttcaccgctgctttggttcttggcgtgtgctaccaacagctaggctggttgtcccacgactattgccatcaccaggttttcacaaaccgcaagattaacgacgctttcggtctctttttcggtaacgtgatgcagggatactcacagacttggtggaaggataggcacaatggtcaccatgccgccaccaatgtggtcggccatgacccagatattgataacctccccatcctggcttggtctcccgaagatgtcaagagggctactccttcgactcggaatctcatcaagtaccagcagtactacttcattcccaccattgcatcccttaggttcatctggtgcctccaatccatcggcggcgtcatgtcctacaagagcgaggagaggaacctgtactacaagcgccagtacactaaggaggcgattggtctggccctccactgggtgctcaaggccactttctattgcagtgccatgcctagctttgccaccggtttgggatgcttcttgatctccgagctgctcggaggatttggcattgccatcgttgtgtttctgaatcactatcctttggacaaggttgaggagactgtctgggatgagcacgggttcagcgccagccagatccacgagacgttgaacattaagcccggccttctcaccgattgggtctttggtggtctcaactaccagattgagcaccacttgtggcccaacatgcccaggcacaacctcacggcagcttccctggaggtgcagaagttgtgcgccaagcacaacctgccctacagggccccagccatcatccccggggttcagaaattggtcagcttcttaggcgagattgcccagctggctgctgtccctgaatgagcggccgcatttcgcaccaaatcaatgaaagtaataatgaaaagtctgaataagaatacttaggcttagatgcctttgttacttgtgtaaaataacttgagtcatgtacctttggcggaaacagaataaataaaaggtgaaattccaatgctctatgtataagttagtaatacttaatgtgttctacggttgtttcaatatcatcaaactctaattgaaactttagaaccacaaatctcaatcttttcttaatgaaatgaaaaatcttaattgtaccatgtttatgttaaacaccttacaattggttggagaggaggaccaaccgatgggacaacattgggagaaagagattcaatggagatttggataggagaacaacattctttttcacttcaatacaagatgagtgcaacactaaggatatgtatgagactttcagaagctacgacaacatagatgagtgaggtggtgattcctagcaagaaagacattagaggaagccaaaatcgaacaaggaagacatcaagggcaagagacaggaccatccatctcaggaaaaggagctttgggatagtccgagaagttgtacaagaaattttttggagggtgagtgatgcattgctggtgactttaactcaatcaaaattgagaaagaaagaaaagggagggggctcacatgtgaatagaagggaaacgggagaattttacagttttgatctaatgggcatcccagctagtggtaacatattcaccatgtttaaccttcacgtacgtctagaggatccccgggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctcgaaattaaccctcactaaagggaacaaaagctggagctccaccgcggtggcggccgcaccatggaagcagccaaagaattggtttccatcgtccaagaggagctccccaaggtggactatgcccagctttggcaggatgccagcagctgtgaggtcctttacctctcggtggcattcgtggcgatcaagttcatgctgcgcccactggacctgaagcgccaggccaccttgaagaagctgttcacagcatacaacttcctcatgtcgatctattcctttggctccttcctggccatggcctatgccctatcagtaactggcatcctctccggcgactgtgagacggcgttcaacaacgatgtgttcaggatcacaactcagctgttctacctcagcaagttcgtagagtacatcgactccttctaccttccccttatggacaagccactgtcgttccttcagttcttccatcatttgggggcccccattgacatgtggctattctacaaataccgcaacgaaggagtctggatctttgtcctgttgaatgggttcattcactggatcatgtacggttactattggacgcggctcatcaagctgaacttccccatgcccaagaacctgatcacctccatgcagatcatccagttcaatgtcgggttctacatcgtctggaagtaccgcaatgtgccatgctaccgccaggatgggatgcgcatgtttgcctggatcttcaactactggtatgtcgggacggtcttgctgctgttcctcaacttttacgtgcagacgtacatccggaagccgaggaagaaccgagggaagaaggagcctgggggccccggcaagccaagcgagattgcgtcgctgccaccgccaattcgaccagtcgggaacccacctgcagcctactacgatgccctggcgacc

SEQ ID NO: 512 - DNA, 9241 bp, artificial
  Plasmid pKR1326
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatggaagcagccaaagaattggtttccatcgtccaagaggagctccccaaggtggactatgcccagctttggcaggatgccagcagctgtgaggtcctttacctctcggtggcattcgtggcgatcaagttcatgctgcgcccactggacctgaagcgccaggccaccttgaagaagctgttcacagcatacaacttcctcatgtcgatctattcctttggctccttcctggccatggcctatgccctatcagtaactggcatcctctccggcgactgtgagacggcgttcaacaacgatgtgttcaggatcacaactcagctgttctacctcagcaagttcgtagagtacatcgactccttctaccttccccttatggacaagccactgtcgttccttcagttcttccatcatttgggggcccccattgacatgtggctattctacaaataccgcaacgaaggagtctggatctttgtcctgttgaatgggttcattcactggatcatgtacggttactattggacgcggctcatcaagctgaacttccccatgcccaagaacctgatcacctccatgcagatcatccagttcaatgtcgggttctacatcgtctggaagtaccgcaatgtgccatgctaccgccaggatgggatgcgcatgtttgcctggatcttcaactactggtatgtcgggacggtcttgctgctgttcctcaacttttacgtgcagacgtacatccggaagccgaggaagaaccgagggaagaaggagcctgggggccccggcaagccaagcgagattgcgtcgctgccaccgccaattcgaccagtcgggaacccacctgcagcctactacgatgccctggcgaccggccgcaccatgtctcctaagcggcaagctctgccaatcacaattgatggcgcaacttatgatgtgtctgcttgggtcaatcaccaccctggaggagctgacattatcgagaactatcgcaaccgcgatgcgaccgatgtcttcatggtgatgcactctcaagaagccgtcgccaagttgaagagaatgcctgttatggagccttcctctcctgacacacctgttgcacccaagcctaagcgtgatgagccccaggaggatttccgcaagttgcgggaggaattcatctccaagggtatgttcgagacgagtttcctttggtatttttacaagacttcaactaccgtcggtttgatggtcctttccatcttgatgaccgtgtacacgaattggtatttcaccgctgctttggttcttggcgtgtgctaccaacagctaggctggttgtcccacgactattgccatcaccaggttttcacaaaccgcaagattaacgacgctttcggtctctttttcggtaacgtgatgcagggatactcacagacttggtggaaggataggcacaatggtcaccatgccgccaccaatgtggtcggccatgacccagatattgataacctccccatcctggcttggtctcccgaagatgtcaagagggctactccttcgactcggaatctcatcaagtaccagcagtactacttcattcccaccattgcatcccttaggttcatctggtgcctccaatccatcggcggcgtcatgtcctacaagagcgaggagaggaacctgtactacaagcgccagtacactaaggaggcgattggtctggccctccactgggtgctcaaggccactttctattgcagtgccatgcctagctttgccaccggtttgggatgcttcttgatctccgagctgctcggaggatttggcattgccatcgttgtgtttctgaatcactatcctttggacaaggttgaggagactgtctgggatgagcacgggttcagcgccagccagatccacgagacgttgaacattaagcccggccttctcaccgattgggtctttggtggtctcaactaccagattgagcaccacttgtggcccaacatgcccaggcacaacctcacggcagcttccctggaggtgcagaagttgtgcgccaagcacaacctgccctacagggccccagccatcatccccggggttcagaaattggtcagcttcttaggcgagattgcccagctggctgctgtccctgaatgagc

SEQ ID NO: 513 - protein, 258 aa, Euglena gracilis; identical to SEQ ID NO: 319

SEQ ID NO: 514 - protein, 420 aa, Tetruetreptia pomquetensis CCMP1491
MSPKRQALPITIDGATYDVSAWVNHHPGGADIIENYRNRDATDVFMVMHSQEAVAKLKRMPVMEPSSPDTPVAPKPKRDEPQEDFRKLREEFISKGMFETSFLWYFYKTSTTVGLMVLSILMTVYTNWYFTAALVLGVCYQQLGWLSHDYCHHQVFTNRKINDAFGLFFGNVMQGYSQTWWKDRHNGHHAATNVVGHDPDIDNLPILAWSPEDVKRATPSTRNLIKYQQYYFIPTIASLRFIWCLQSIGGVMSYKSEERNLYYKRQYTKEAIGLALHWVLKATFYCSAMPSFATGLGCFLISELLGGFGIAIVVFLNHYPLDKVEETVWDEHGFSASQIHETLNIKPGLLTDWVFGGLNYQIEHHLWPNMPRHNLTAASLEVQKLCAKHNLPYRAPAIIPGVQKLVSFLGEIAQLAAVPE

SEQ ID NO: 515 - protein, 700 aa, artificial
  EgD9e/TpomD8fusion
MEVVNEIVSIGQEVLPKVDYAQLWSDASHCEVLYLSIAFVILKFTLGPLGPKGQSRMKFVFTNYNLLMSIYSLGSFLSMAYAMYTIGVMSDNCEKAFDNNVFRITTQLFYLSKFLEYIDSFYLPLMGKPLTWLQFFHHLGAPMDMWLFYNYRNEAVWIFVLLNGFIHWIMYGYYWTRLIKLKFPMPKSLITSMQIIQFNVGFYIVWKYRNIPCYRQDGMRMFGWFFNYFYVGTVLCLFLNFYVQTYIVRKHKGAKKIQPARPAGLPPATYYDSLAVSGRTMSPKRQALPITIDGATYDVSAWVNHHPGGADIIENYRNRDATDVFMVMHSQEAVAKLKRMPVMEPSSPDTPVAPKPKRDEPQEDFRKLREEFISKGMFETSFLWYFYKTSTTVGLMVLSILMTVYTNWYFTAALVLGVCYQQLGWLSHDYCHHQVFTNRKINDAFGLFFGNVMQGYSQTWWKDRHNGHHAATNVVGHDPDIDNLPILAWSPEDVKRATPSTRNLIKYQQYYFIPTIASLRFIWCLQSIGGVMSYKSEERNLYYKRQYTKEAIGLALHWVLKATFYCSAMPSFATGLGCFLISELLGGFGIAIVVFLNHYPLDKVEETVWDEHGFSASQIHETLNIKPGLLTDWVFGGLNYQIEHHLWPNMPRHNLTAASLEVQKLCAKHNLPYRAPAIIPGVQKLVSFLGEIAQLAAVPE

SEQ ID NO: 516 - protein, 700 aa, Artificial
  EgD9e/EaD8fusion
MEVVNEIVSIGQEVLPKVDYAQLWSDASHCEVLYLSIAFVILKFTLGPLGPKGQSRMKFVFTNYNLLMSIYSLGSFLSMAYAMYTIGVMSDNCEKAFDNNVFRITTQLFYLSKFLEYIDSFYLPLMGKPLTWLQFFHHLGAPMDMWLFYNYRNEAVWIFVLLNGFIHWIMYGYYWTRLIKLKFPMPKSLITSMQIIQFNVGFYIVWKYRNIPCYRQDGMRMFGWFFNYFYVGTVLCLFLNFYVQTYIVRKHKGAKKIQPARPAGLPPATYYDSLAVSGRTMVKRPALPLTVDGVTYDVSAWLNHHPGGADIIENYRGRDATDVFMVMHSENAVSKLRRMPIMEPSSPLTPTPPKPNSDEPQEDFRKLRDELIAAGMFDASPMWYAYKTLSTLGLGVLAVLLMTQWHWYLVGAIVLGIHFQQMGWLSHDICHHQLFKDRSINNAIGLLFGNVLQGFSVTWWKDRHNAHHSATNVQGHDPDIDNLPLLAWSKEDVERAGPFSRRMIKYQQYYFFFICALLRFIWCFQSIHTATGLKDRSNQYYRRQYEKESVGLALHWGLKALFYYFYMPSFLTGLMVFFVSELLGGFGIAIVVFMNHYPLEKIQDSVWDGHGFCAGQIHETMNVQRGLVTDWFFGGLNYQIEHHLWPTLPRHNLTAASIKVEQLCKKHNLPYRSPPMLEGVGILISYLGTFARMVAKADKA

SEQ ID NO: 517 - protein, 700 aa, Artificial
  EaD9e/TpomD8 fusion
MEAAKELVSIVQEELPKVDYAQLWQDASSCEVLYLSVAFVAIKFMLRPLDLKRQATLKKLFTAYNFLMSIYSFGSFLAMAYALSVTGILSGDCETAFNNDVFRITTQLFYLSKFVEYIDSFYLPLMDKPLSFLQFFHHLGAPIDMWLFYKYRNEGVWIFVLLNGFIHWIMYGYYWTRLIKLNFPMPKNLITSMQIIQFNVGFYIVWKYRNVPCYRQDGMRMFAWIFNYWYVGTVLLLFLNFYVQTYIRKPRKNRGKKEPARPAGLPPATYYDSLAVSGRTMSPKRQALPITIDGATYDVSAWVNHHPGGADIIENYRNRDATDVFMVMHSQEAVAKLKRMPVMEPSSPDTPVAPKPKRDEPQEDFRKLREEFISKGMFETSFLWYFYKTSTTVGLMVLSILMTVYTNWYFTAALVLGVCYQQLGWLSHDYCHHQVFTNRKINDAFGLFFGNVMQGYSQTWWKDRHNGHHAATNVVGHDPDIDNLPILAWSPEDVKRATPSTRNLIKYQQYYFIPTIASLRFIWCLQSIGGVMSYKSEERNLYYKRQYTKEAIGLALHWVLKATFYCSAMPSFATGLGCFLISELLGGFGIAIVVFLNHYPLDKVEETVWDEHGFSASQIHETLNIKPGLLTDWVFGGLNYQIEHHLWPNMPRHNLTAASLEVQKLCAKHNLPYRAPAIIPGVQKLVSFLGEIAQLAAVPE

SEQ ID NO: 518 - protein, 700 aa, Artificial
  EaD9e/EaD8 fusion
MEAAKELVSIVQEELPKVDYAQLWQDASSCEVLYLSVAFVAIKFMLRPLDLKRQATLKKLFTAYNFLMSIYSFGSFLAMAYALSVTGILSGDCETAFNNDVFRITTQLFYLSKFVEYIDSFYLPLMDKPLSFLQFFHHLGAPIDMWLFYKYRNEGVWIFVLLNGFIHWIMYGYYWTRLIKLNFPMPKNLITSMQIIQFNVGFYIVWKYRNVPCYRQDGMRMFAWIFNYWYVGTVLLLFLNFYVQTYIRKPRKNRGKKEPARPAGLPPATYYDSLAVSGRTMVKRPALPLTVDGVTYDVSAWLNHHPGGADIIENYRGRDATDVFMVMHSENAVSKLRRMPIMEPSSPLTPTPPKPNSDEPQEDFRKLRDELIAAGMFDASPMWYAYKTLSTLGLGVLAVLLMTQWHWYLVGAIVLGIHFQQMGWLSHDICHHQLFKDRSINNAIGLLFGNVLQGFSVTWWKDRHNAHHSATNVQGHDPDIDNLPLLAWSKEDVERAGPFSRRMIKYQQYYFFFICALLRFIWCFQSIHTATGLKDRSNQYYRRQYEKESVGLALHWGLKALFYYFYMPSFLTGLMVFFVSELLGGFGIAIVVFMNHYPLEKIQDSVWDGHGFCAGQIHETMNVQRGLVTDWFFGGLNYQIEHHLWPTLPRHNLTAASIKVEQLCKKHNLPYRSPPMLEGVGILISYLGTFARMVAKADKA

SEQ ID NO: 519 - protein, 703 aa, Artificial
  EgD9e/PavD8 fusion
MEVVNEIVSIGQEVLPKVDYAQLWSDASHCEVLYLSIAFVILKFTLGPLGPKGQSRMKFVFTNYNLLMSIYSLGSFLSMAYAMYTIGVMSDNCEKAFDNNVFRITTQLFYLSKFLEYIDSFYLPLMGKPLTWLQFFHHLGAPMDMWLFYNYRNEAVWIFVLLNGFIHWIMYGYYWTRLIKLKFPMPKSLITSMQIIQFNVGFYIVWKYRNIPCYRQDGMRMFGWFFNYFYVGTVLCLFLNFYVQTYIVRKHKGAKKIQPARPAGLPPATYYDSLAVSGRTMGKGGDGGAQAVSGTDASLAEVSSVDSKSVHVVLYGKRVDVTKFQKAHPGGSKVFRIFQERDATEQFESYHSPKAIKMMEGMLKKSEDAPASVPLPSRSTMGTEFKEMIERHKRAGLYDPCPLDELFKLTIVLAPIFVGAYLVRSGVSPLAGALSMGFGFYLDGWLAHDYLHHAVFKGSVNTLVKANNAMGYALGFLQGYDVAWWRARHNTHHVCTNEDGSDPDIKTAPLLIYVRENPSIAKRLNFFQRWQQYYYVPTMAILDLYWRLESIAYVAVRLPKMWMQAAALAAHYALLCWVFAAHLNLIPLMMVARGFATGIVVFATHYGEDILDREHVEGMTLVEQTAKTSRNITGGWLVNVLTGFISLQTEHHLFPMMPTGNLMTIQPEVRDFFKKHGLEYREGNLFQCVHQNIKALAFEHLLH

---

What is claimed is:

1. A method for the conversion of linoleic acid to dihomo gamma-linolenic acid, comprising:
   a) providing a recombinant microbial host cell comprising:
      i) a DGLA synthase comprising an amino acid sequence selected from the group consisting of SEQ ID NO:441, SEQ ID NO:447, SEQ ID NO:454, SEQ ID NO:461, SEQ ID NO:464, SEQ ID NO:471, SEQ ID NO:515, SEQ ID NO:516, SEQ ID NO:517, SEQ ID NO:518, and SEQ ID NO:519; and
      ii) a source of linoleic acid; and
   b) growing the host cell of (a) under conditions whereby dihomo gamma-linolenic acid is produced.

2. A method for the conversion of alpha-linolenic acid to eicosatetraenoic acid, comprising:
   a) providing a recombinant microbial host cell comprising:
      i) a DGLA synthase comprising an amino acid sequence selected from the group consisting of SEQ ID NO:441, SEQ ID NO:447, SEQ ID NO:454, SEQ ID NO:461, SEQ ID NO:464, SEQ ID NO:471, SEQ ID NO:515, SEQ ID NO:516, SEQ ID NO:517, SEQ ID NO:518, and SEQ ID NO:519; and
ii) a source of alpha-linolenic acid; and
b) growing the host cell of (a) under conditions whereby eicosatetraenoic acid is produced.

3. A method for the conversion of linoleic acid to dihomo-gamma-linolenic acid comprising:
a) providing a recombinant microbial host cell comprising:
i) a DGLA synthase comprising:
1) at least one delta-9 elongase having an amino acid sequence selected from the group consisting of SEQ ID NO:254, SEQ ID NO:255, SEQ ID NO:319, SEQ ID NO:359, SEQ ID NO:420, SEQ ID NO:422, and SEQ ID NO:513;
2) at least one delta-8 desaturase; and
3) a linker selected from the group consisting of a polypeptide bond, SEQ ID NO:198, SEQ ID NO:200, SEQ ID NO:235, SEQ ID NO:438, SEQ ID NO:445, SEQ ID NO:472, and SEQ ID NO:504; wherein the linker is interposed between the delta-9 elongase and the delta-8 desaturase such that the delta-9 elongase is located at the N-terminus of the DGLA synthase; and
ii) a source of linoleic acid; and
b) growing the host cell of (a) under conditions whereby dihomo-gamma-linolenic acid is produced.

4. A method for the conversion of linoleic acid to dihomo-gamma-linolenic acid comprising:
a) providing a recombinant microbial host cell comprising:
i) a DGLA synthase comprising:
1) at least one delta-9 elongase;
2) at least one delta-8 desaturase having an amino acid sequence selected from the group consisting of SEQ ID NO:328, SEQ ID NO:424, SEQ ID NO:426, SEQ ID NO:428, SEQ ID NO:430, and SEQ ID NO:514; and
3) a linker selected from the group consisting of a polypeptide bond, SEQ ID NO:198, SEQ ID NO:200, SEQ ID NO:235, SEQ ID NO:438, SEQ ID NO:445, SEQ ID NO:472, and SEQ ID NO:504;
wherein the linker is interposed between the delta-9 elongase and the delta-8 desaturase such that the delta-9 elongase is located at the N-terminus of the DGLA synthase; and
ii) a source of linoleic acid; and
b) growing the host cell of (a) under conditions whereby dihomo-gamma-linolenic acid is produced.

5. A host cell comprising in its genome the recombinant construct of claim 4.

6. The host cell of claim 5, wherein said cell is selected from the group consisting of plants and yeast.

7. A transformed *Yarrowia* comprising the recombinant construct of claim 4.

8. A method for transforming a cell, comprising transforming a cell with the recombinant construct of claim 4 and selecting those cells transformed with said recombinant construct.

9. A method for producing a transformed plant comprising transforming a plant cell with the recombinant construct of claim 4 and regenerating a plant from the transformed plant cell.

10. The method of claim 9, wherein the plant is a soybean plant.

11. A method for producing yeast, comprising transforming a yeast cell with the recombinant construct of claim 4 and growing yeast from the transformed yeast cell.

12. A plant comprising in its genome the recombinant construct of claim 4.

13. The plant of claim 12, wherein the plant is an oilseed plant.

14. The plant of either of claim 12 or 13, wherein the plant is soybean.

15. Seed obtained from the plant of either of claim 12 or 13, wherein the seed comprises the recombinant construct.

16. Seed obtained from the plant of claim 14, wherein the seed comprises the recombinant construct.

17. A method for the conversion of alpha-linolenic acid to eicosatetraenoic acid, comprising:
a) providing a recombinant microbial host cell comprising:
i) a DGLA synthase comprising:
1) at least one delta-9 elongase having an amino acid sequence selected from the group consisting of SEQ ID NO:254, SEQ ID NO:255, SEQ ID NO:319, SEQ ID NO:359, SEQ ID NO:420, SEQ ID NO:422, and SEQ ID NO:513;
2) at least one delta-8 desaturase; and
3) a linker selected from the group consisting of a polypeptide bond, SEQ ID NO:198, SEQ ID NO:200, SEQ ID NO:235, SEQ ID NO:438, SEQ ID NO:445, SEQ ID NO:472, and SEQ ID NO:504;
wherein the linker is interposed between the delta-9 elongase and the delta-8 desaturase such that the delta-9 elongase is located at the N-terminus of the DGLA synthase; and
ii) a source of alpha-linolenic acid; and
b) growing the host cell of (a) under conditions whereby eicosatetraenoic acid is produced.

18. A method for the conversion of alpha-linolenic acid to eicosatetraenoic acid, comprising:
a) providing a recombinant microbial host cell comprising:
i) a DGLA synthase comprising:
1) at least one delta-9 elongase;
2) at least one delta-8 desaturase having an amino acid sequence selected from the group consisting of SEQ ID NO:328, SEQ ID NO:424, SEQ ID NO:426, SEQ ID NO:428, SEQ ID NO:430, and SEQ ID NO:514; and
3) a linker selected from the group consisting of a polypeptide bond, SEQ ID NO:198, SEQ ID NO:200, SEQ ID NO:235, SEQ ID NO:438, SEQ ID NO:445, SEQ ID NO:472, and SEQ ID NO:504;
wherein the linker is interposed between the delta-9 elongase and the delta-8 desaturase such that the delta-9 elongase is located at the N-terminus of the DGLA synthase; and
ii) a source of alpha-linolenic acid; and
b) growing the host cell of (a) under conditions whereby eicosatetraenoic acid is produced.

19. A DGLA synthase comprising:
(i) at least one delta-9 elongase having an amino acid sequence selected from the group consisting of SEQ ID NO:254, SEQ ID NO:255, SEQ ID NO:319, SEQ ID NO:359, SEQ ID NO:420, SEQ ID NO:422, and SEQ ID NO:513;
(ii) at least one delta-8 desaturase; and
(iii) a linker selected from the group consisting of a polypeptide bond, SEQ ID NO:198, SEQ ID NO:200, SEQ ID NO:235, SEQ ID NO:438, SEQ ID NO:445, SEQ ID NO:472, and SEQ ID NO:504;

wherein the linker is interposed between the delta-9 elongase and the delta-8 desaturase such that the delta-9 elongase is located at the N-terminus of the DGLA synthase.

20. A DGLA synthase comprising:
(i) at least one delta-9 elongase;
(ii) at least one delta-8 desaturase having an amino acid sequence selected from the group consisting of SEQ ID NO:328, SEQ ID NO:424, SEQ ID NO:426, SEQ ID NO:428, SEQ ID NO:430, and SEQ ID NO:514; and
(iii) a linker selected from the group consisting of a polypeptide bond, SEQ ID NO:198, SEQ ID NO:200, SEQ ID NO:235, SEQ ID NO:438, SEQ ID NO:445, SEQ ID NO:472, and SEQ ID NO:504;
wherein the linker is interposed between the delta-9 elongase and the delta-8 desaturase such that the delta-9 elongase is located at the N-terminus of the DGLA synthase.

* * * * *